United States Patent 12,509,677 (PROBIOTIC STRAINS HAVING INCREASED STORAGE STABILITY) - sequence listing, part 4

SEQ ID NO: 4 - DNA, 1846542 bp, Lactobacillus paracasei
tagttcgtctgatatggctctgcctatgcgcagtttgcatcagtaggtgtaaaaggagtaggtagtcttgtcaaaggcatgggtggcttagctgctgctactgatgacccaaagcaagcgatgaagacattgatggaacaaggcacacagatggccgcaaagccaatggttcaatgggctgacttccgtctgatgctagaacagactcctgctggtatggcagccgttgctaaagcaatgggcatgagcaccaaagaactggttcagaatgttcaaaacggcaaaataagcacgcagcaattcttcgatggtatcgaaaaggcaggcaacagcaaggctttccagaagatggcacgagttacaagacagtaggcgaggcaatggacggccttcaggaaacactggcaaacaagcttcagcctgcatggcaggcaatgtctaaagtcgctatcggagctattagtggaattatcgataagatcggagccatgaacttcgattcagttcttgcttcaattggtcgcttcttttctccgttttcggcattgattatgaatattaagacacaactaagcagcttaggtaagggcgactcgatgagcggactcagttccgttttcaaaggagtagggtccgttttacaaaccatttggagcctagttggtagcttagccaatgttgcatttgtcaatctgattggcattgctcaaaaagttggtggtgcgttcaattcggtgtttggtggtgggaagatttcgggagttttcgatggtatcaagcaagccgtcactgactttggctatgcagccatgggagccatcacaactgttagtgatattattgctaacttaccgtggaaagcaatttttgaaggtgttaaggcggctttaactggtgttgttaacgtgctgaagccaattgcagctattgtcaaagcagcatttgcaaacgacattgttaagtcgtttgcagtggcaatcttaggagctgtgggagcctttaagggtattagtttggcccttgaaggattctccagtgtcatcggaatcttttcgaggatgatcggcccaattcgtggcgttatcgctgttgttactaattttggaacgattgcgaaaactgctggcggtatttggaaggctttcggattgatcttaggcatgaatccgtgggtacttttgattgctgggattgcggcagtggttgctggtctggtgtacttttttacccaaacccagactggtcaaaaactatggtcgggatttgtttcgtggttacaaggagcttggcaaggacttgtaggagttgcgcaaactgtttggaatgctatatctggtgcgtttacatctgcaattagcggcattcaaacagcttggagcggaattacaggtttctttagcaatctatggactgggattacgaccacggcatcagctgcttgggtggcattcacaaccactctctcagctatctggcaaggtgctgttacttcagcaacggcagtttggaacgcgctatccacattcttcacgactctatggaatggaatagtagcagtagccactgctgtatggtcaacctttggcggttccctgacgacaatttggaatgggattgtccaagttgctaccggtgtttggaacatgcttaaagcagttattatgggtcccattcttattgtcattgatttgcttactgcaaattggacacagctaggcgctgatctccagctgatctggaacagcattgtttccgccgctggtcagatatggaatggccttgttacgtatttctccggtatttggagccttattcaaacttatgcaatgactgtttggaatactttggtttcaactttagaggggctttggaatggtgcagtatctgccgcttccgctatttggagtgcgctttcgtcatttttcagcggattgtggaacggtattgtgtctaccaccgaaggcatatggaacagtgttgtttcattcttatcaggactatggagcggaacagtcagcacagccgagggaatttggaacgcacttcccggattcttttccggattgtggaacagcattacatcatttttttcatcagcttggagcaacataaagtctattgtgattggagctgctactagtatttttaatggtgctaaggctgtatggtctggttttactggcatggtaagtggaatagttaatggcatcaaaggagcattcaatgcgcttcgtaattttagcttggctgacgctggccgcgctatcatggatagcttcttcaatggcctcaaagcggcttggggaagatcactgattttgttggcggaattgcttcttggattcgcaagcataaaggcccaatcagttacgatgccaagctgctcatacctgccggtaacgccatcatgaacggcttgaatgcagggcttactgacaagttctcacatgtccaaaagaacgtttcgagcatggcgcaagctattgttgacagtgctgctgttacgatgccggcagtgaatacttctccatttgatgcatcattgcagtcgcttaatagcagtgttcagggtgcaaccttgtcttcaaatcttgatgtcaactacactcgcaagcaaacgattgaggttcctctgtacattgatggccgagaggttgctcgtgcaactgcaaacccaatgcaaacagagcttaatcgtttgacaaaggtaagcaattatcgaaaggggttagtctaattgtacgatttcagagaaacgacacccttcacgggtgcagacgataatcagcttccagcagaagcgatgctaatcgatggacaatacattgagaatcttgtgcccggatataggacacttcaggtcggagggcgtgagcttcttaaacaagacgctaaaagcaatcctataggaatatctgatggcgaaatgctggagtatgtacgaaacccatctcgggaaataactgttggatatcagcttatagcagctgacgaaaagtcgtttcgcactgccttctataagctaagtggcatcttgcacggtgacactcatcaggtttcgttcaatgatgacttgtctgtgtactggaatgccgttctcacagatgttgacgatgttcctaaaggcagaaacgcaattacatcttcgttcacgctattcgttcccgatggcatcgcccactcggtagccacgaagacgtttgacaacatgccatacaaggacatgccagtgaatttgttgacagggacaagctatatggctactgctgaatccgtacccaagggcgcctttaaagccagcaatgcaaaaaccgtttcggtttcaagcggggaaacttatacgtactcaattgaaattccgtctaacaatacagttgacttagaagcggcaataaatcttaactctaaaggggtttttgtaagatcagtgatcggaaatgttatcaaatcagggcaatcaggtatttcaacgattacccttacggtcccagatggaattgacagcctgtttttagcaataagtcttacaactgtaaatccaaattcagcgacaactatttatgaagccggtgaaaagtttgagctaggcaaaactgcttctccatggtcgcctaacccagctgatcctgaatactataccaacaccatcacggtgcacaatggcggcacttatcctgttgagccagttattacggcaactatgcatgctgataacggcatggttgggattgtcaatgatcgcccgggtattctccaatttggcacgcaagaaattgatggtttcaccaccgaagaaagcgaagtggcacttgatttggcagccgttcaaggctcgcacatggataatcaagccgccacaaacaatccctattggggtggtgatcctagtatgcctaatgaacagattggcaatgcgatttggacgcaggacggctacgatggctggaaggttgagcctaattggcccagtattactggcgaccacaagtattggaacggtccttcaatcaagcacaatctcgtccagacgcataacggtaacttcaagagcaatctcacatgggacgttatgacacgcttccaaactggggtagcacaggtaggtgcgctcgaaacaacgttagagagtgacggtaagccaatttttcagatgatactgaaggataatagcgcattgtccgatcagctttggtggatgtgctattacaaagatcaactggtcgtcaatgaacaacttgatcgtagcattttcactaacgacaagttcattcagttggaattacaaaaatttggtaattcagttgttttccgagtgtcaccatggattggcaatcaaggacgagagacgactattacccgccagtttacctttgcggacgctgccgatactgaaactaaacaattttccacgtggttcatgcgagacaagacatggggcgagtcgactatgtatctgattgcgtccaccgtcaaatggcaaaacgttagctggtatacgaatatcaagaatcgttttagcgatggtgatgttctcaagattgatgtggcgaacgctaagacgtacttgaatggttctcttgacccaaccatgcacacgttaggtaatcaatgggagcaattcaaactgccgcccggtgatactgagattgctatcacgccctcgagctgggcacaaccatttgcgtgtgaagtcgagataagggaggcctggctataaatgaagtattactttgcagatcgaaaatcaaacattttgggtgttgggtcgaccgatggcaaaggcgaatggcgaattgacaacgatatcgaaacacaaagtgttgataatcgtcctgcggtcgagctttctcttgatattcacttcacgactgatcaggaacaagcagtcaatgagatggctaaagcaaccaacttcatcatgtatcaagatgaagaaggcaatgctcaccaaatggtgattgaatcggttgaccatgattcactaggccacattcactcaattgttgccagcgatgctggtaatgatttaattaacgaaaccgttggcgccttcaaggccgacaagccatatacgattgctgaatacatcctcatgtttacaaatgattctggctgggagattggcatcaacgaatttcctgacaatgttcgaacactcgagtggactagtgaagaatcatcgttggctcgcattattgccgtggcaaaagattttgatgcagtgcttagttttggctttgagtttgttggaaccaacttggttaagcgtgtcattaacattcggcatgaaacggccggtgacagcttgatttcctttgaaatgaataaggacatcaacaatatcgtcacgcacctcgatacctatgacatggaaacatcgattaaggcttatggagcggtgccagaaagcacggatggatcaactaatcaggatccaatcaacttgatcggctacaaatggactgatccaacgggacagtttgtgcttgatcagtacgggttcttgcacgataccattgctgtgcagaaatattcacgtttgttaagcaacagcaaccctaacccaacacagtctgactggaatcgggttaaaacgtttgattcaaaatcgcaggcggcacttttgcaagcggctttggcagacttgaaaaagtataaccacccaaacgaaacgtacgacattgatttggttaattcgccatacgtaccgcttaatcaaaccgtccacattgccgatgagaatcaacagctattcctgtctgccaaagtgttgagcattcagcgcagccgtgctaaccattctgtcaagcttactttgggtgagttcgctcatgaaacagtcagctttgaccaacggctcagcgatcttgccaataagatggccaacatgcccaagactattcagttttatccatggcttcgttatgccgatgatgacaaaggcactaacatgagtgccttcccaactggtaagaagtatatggcaatcgtttggtcaaataagacatccgttccaagtgataatccggttgattatgctggcaagtgggcattgattcagggcaaagatggcgctgacggtgttccgggtgcaaaaggcgctgatggccgtacaagctatttccacactgcttgggcgaatgatgtaagcggccaaagcgggttcacagtatccggcggtgatggcaaaaagtatattggtacgtacagcgacttcacgcaggccgatagcaccaatccagctgtttatagttggcaactggtacaagggccaaagggcgatactggtccgcaaggtccacagggaccacgaggtccgcaaggtgttcccggaagcaaggatgtgccatacacgtacattcagttgggcacgcctgctagccccaagaaaggcgatttgtggtggcatgggacaacacttaacgatgccacagccctgcaatactataacggtacagcttgggttgatcaaagcattcagcaggcggttctcagtatcaaaaagctgcaatcaattgagattgacacatcaaccatcaattcgcctgacattaattcgccattcagccacgttcagattgacggtgccaagagttctggcaatcttgaactcaaagatgcgcatctaagtatattgggcaacattgaagacaataatggcaatcccaacggtcaatactacaaatcacttttgagcccaaacggtatgttcaactacatcacaacgcctgatcaaaaggggagcgtgtcgtcagttgcgctccaacgtggtgcacttcagttacaaacgctgatcagtgaccccagtgccgctacaaaaaaatatattcagtctgaattcacttcaaaagacaacgtgacatttttccatgttgatacaaccccagcaaaaaatattgatattgattgggcatatatttactacacaagacgtggcaatttagtgaccgtcaactttcaatttcacacaatagctaatcagtacaattatttgaggctcgcagatattagacctggttacacaccttatttgaaagacaaaattgttgcaagctgttctaacttttcaaatccaagtagttcgtcagctatctattcaagtacacctcgtggtgggactgtgggatggtatggtgctcttactcatgactttggtagttggggaggatctgtttcttacctaaccttagatgactatccaacggggatacattttttaactaggaggcaattatgaaattaaaagtgtggacggatagcaataatcggctgcttaattgggcatatgctgatgaaaatagaccagtaggtccgaccgatgaaggattcaaggttattgaagttgatgaggccattggcttgtatgagaaccacgccagcattgttgatggcaaggttgttccagatgctgactattccccagatgcttacagacctgcacctgagccgtctgcggctgacttagcaaatgctgaaactatgaagatggttgctagtctaactatgtcaaactcagctttgataaagcaggtggcaacattgaccaaggaggcaaaatcgtgagcgcatataaaccattgattatcagttactatcagcaaggaatctataataaggatgacttagccttgttcgtgagtgtcggatggattagccaagcagaagtagatgagcttgttaagcaagtcgccagcaaaagctagcgactatttttgtggaaggaagtgaaaaagtgacattttttggatacacgattggtgactgggcggagttaatatcaatcataggggtgggcgtgagcgctggcagctggctgttcaaaaagattgccctagatccattgcgttctgacattcaaatgctttcagagacgattaatcgtcagctcaaactgcacgaacaatcgctggcagacttgaatactcatctgaaagcacatgatgaagagcttggcagtcactcggttaggattactcgattggaagaccatgtaggcattaaaggagataatgatgatgaataactggacagaacttttggtatcacttgcagtagcagcagtcccaatcattggggcttggatctcaaaacagttgctggctaacaagcaagcgctcactttggtaaaggtattaggcccattggcaaatgctgcggtaacagcggcagaacagcttggtgtgacacaggcgattgacggtgaggttaagaaatcgactgccattcaggctgtgaaagacggcttaaaatcgcttggcttcaccagcacagacgagcagacaattgccaacgcggttgagaaagcttttgcggatttgaaagacagcctagcagaaacctatccgcaaaagacagctgatcaggaagcatctaatcaagacaaagtggctgccgcagctcaggctgccgcagacgcagttaaggctcagctggcaccggattctgctgctccacagcaataaggagggcacatgaaatttaaaactaaactaatcaccttggtagtcgccttcttggcggctatttcttttgccttgccatcgcatgtcaatgcggccaagggcgatatcggtgtggactgggcagtttatcagggagccaacgggaaatatggcacgaataacaagttcgcgatcattcaggctggcggtacacaaggcggtacgctgtatgatcaatggacgtatgcaagccaagtcaaggcagcacaggcgaatgggctcaaagtccacacttatctgtggtacggggtcggtggcagtgctgatattggccgacaggcacttgactacttccttcccaagattctaacgccgaaaggttctattgttgctcttgattatgaggacggtgcctcatcaagtatggctgccaataccgatgccattctatatggtatgcggcgcattgcgcaggcgggatatacgccaatgtattacagctacaagccgtatacactggcacacgttgactatcagcgcattctagcggagtttcccaattcactgtggatcgcggcctatccggactatcagattcgggcattgccagattatggtgtattcccgtcaatgcccggcattgcgctctaccaatttacttctatgcatgcggcaggcggtcttgatggcaacgttgacttgcttggcgtaaccgataatggatacagtcaacaacctgtcgcgccatcaaagcccgcaacaccatcgcaaccgtctacttcaacagcagccagtgataccgactatgcgcaaactggtgttttcaagccgtccgcgactgttaacattcgcactggtgccggcaccggctatgcatccgttggtagctacgcacccggtgaaagtgtgatttatgatcacgtgtatatccgtggcacatatgtttgggcacgttatctcagctactcaggcaggtatcattatgttgccttgggcgtgaatggtggggagagctatggctcgcgttcgtctggatatacttcgccggtaagccacacgtactacactgtccgctctggtgacagcttctggagtattgccagcaagtatggcatcagcatgtacacgttagcggctaacaacggtaagtcaatctacagcctgatctacccgggcgaaagcctgtatatcaggtaacaaaaaggtcctctgctcgctaaggcgggtggagggcttttttacttatgcaataatataaatataagtaattcgtggtgaagttgtggtgaagtgaatccgaaattatgaaacctaagaaattgatatagagctatttttgcttttacaccggcgatttgaaaccctatgaaatcagtgctcaagcaaatcacaacaagaagaacatgttcgcattgctcggccgtccgggttatgaggatatgaccaaggaattgaacgcacggctttaatagcgtgggtttgaggtcgtttggataggaaaaaatgagagcctcaaaattgtgttgtaaatgttcgtgactgaattttgactgaatagccaaaagggtcaaaacatttatgtaccaattttgaggctctttttgtgtccgcgggattgccagtactggctttcttttggtgtatagactaaaaacacggtgtgatttcagcgggtgataaacgacatcgcgaaatcaagcctatatccatatattgacccaatatctagttggcatattaatatcagcggttgagaacgcttgttgcgaactagttcgtgtccgttagtgctattaggtcttagaaaagtgtttcggcaacgctacttcaagccagcctcaactgaccaatccaactggctttttgagaccatggcaacagcgtgatattgtaaccctctgctgccgactgaaagcttggcgaaatattacgttccaggtcgtttgcgaacaagtaaaacttaatttcatcattaaatgaacgtacatatgtaattgaaaagattggttctttgtaggcatttccagttggattattcactagttttaatgccttagcggaggttgttttcgttcgaccaatcagaatttcaaagttgatgttattgccactttgacctgtgtctttaacattcgtattgaccgaaatatcgctgttaattaagaagttgacaacatcttctagaaataagtctttggttctatctcttgaagttgcgagcatatcgccaacctgcgtgatgcattgaataagctgtaattctgcctgtgcatatttggagagggaaggtattttgatggttagctcaccagttggggcatattgaacgccgaaggaaaggagagtgtcattgaaatacttctttcttttaactgatgtgttcgtgtcaaatcctaaggttccaagttcgtccatggtataaccgtcatcactcagcatcaaattgccatcagcgtctttgtatgaaaccagagaaatattatcatgaaacatgtctggaaacggcgtgcgaatctcaatgaagtggttcttgtccttataagaaaacgatacatctaaccacttaatgcgagccctttttaaggcttcaattgttggcatgtccatgatttgcctctttcttgctctgtacgaagacagcctttgcacggttaaggatttaacgatgacattgtccaaacaatcgtttatggtgtttgattgaaaaattaagcatggtcattcatgcgcaatatttctaaaggctcagtcagaaattcattgattccagccaaaaacttttgaaaatgcgccgtcccattatgactttcaaccgcttcagcatctcgccaatgttcgatgatttcatattcattcggagtggtgagactttgatagtgatcgtagctaaggttcccttgttccgcacgtgaaccttggaccaaagcggcgatgaattgccgatatgctgcatcacgatctggtttgacgacaagtttgacattaatgattttcattttaaatcctccatttttttgtgtatgtcatatgatgatggaagctgggtcgccaagaaacgttttcgatccatggctagcttctttttgcatcagtacttggtgcctattatacggagtgattcagattgtatcaattttaaaaagcagcgtacatgggtggtatcaatgatgtgtttaagtctaaaaaatcaccatcagcacaaatgctgcctccatgattaacaagccaaatagggccgtgatcctaccgataaaactgcggtgaccttgttcaagtgagaaggggagaatgtcttctttgctcgacggtgatatttcgaaatacttctccatcatgtgacgtgagattgtgtatgactgacagcttagataaatcaaagtgatggtgacaattaccgttagccaagcgcttacacggcaaactgttgggtcagcgtagacattaagttggtagatgccagcaatcaggaaaccgatgcaggcactcagactgaataggttaaggcgaagtagcaaagcgactttttcggcccgtttcatttcttcaggaaatgttttcaacatttttgccgataacctgacaacttgataagaattggcaccttttgtcggacgttttgcttttatgactttaacgacaccagttatttctgtgatggcaccgattgttaaaagaagcaggataccgtcaaaaaagatttgatttgtcatgagggacctccaaaaactgaatcaaaaaagccgcttcgactgttatgacgtctaacggctttaagtgacgctgatagattttaattcttagtgcttgtcccatcagcatagttgattgtataaccaggttcaatattaaaaatgtaaacattaaaatagacttgattatcaccaatactttgcgcacgcatctgaacaccacgagccactaattcattgccacggaaaattggtttgacttcgtagcggacataatggctggtgctttgtttgaggtaataagcgatatccatctcatgagccagcatgagtggtgtattaagggtttgcgtgccggtcataaggttcttggggttgttgttttcgccggttaattgataaccaataagatggctgcgattgtacagccaaccatgcgcggttttcttgttgtgccagccagttgggttccatgtgagtggttcacgcttggctgttggcatgagtgatttatttaaaagcgcatttgcatctgtcacgcgattttgaccatcgagatcagaataagttgcccaagcacctttggcagtagatagatcagcatcagtgaatgcaggattatttttgttgacaatgatttcttgttggccagtgtagtcaagattggcaagatcggacgctgtcgtggcagcagcacttgttgatgattcacttgcagcaggttgtgttttcgctaacttggctttgagatcggtgatctctttgcgtttttccgtcagttctgaatcaaggctgctgatagctgactgcgtctttttgttagccttggtttggctggcaactggatcgccagctgactttactgaacgactattagttgtactgcaaccgccgagaagaagaacaacaacggccagcggcatgaaaagttgaagtaatttattttttctcatcgtaaggcctttcgataaccagctgcttgtgcatcagcttctgaattgaagtaaaccgcgttggctgaattcatgtgatagccagcttgaccaggcacatggtaaattttgctgcggctgtttccgatgatggtgccttgttcagccgtattcatgtcaccttcattagtcgtggcctgctgtgtttgtgctgcctgttccttagcggctgacttttgagcctcttcagcttgtttggctgcctgtgcagctgcaactgcttgcgatgaggccgcggcggcttgctcagacgcggcaacttggctcgccgatgcttctttggaagctgcctcagatgccgctctagacgatgaagcctcagcttcgctggaagcagcaacttgcgaacttacttcagattctaagctggtctcttgtttgcgaagtgcttttaattcagatgtcttcttggctttcgctgccagtaaaactttcccacgagctttttcgctcttgagttggcgctgctgtttggcagatagcgccttggttttgctggttgacgatgtttgctgtggtgatcccgatgcggctttcgtatctaccagcggtccgccagcgatcaataagacaagcccaccaacgagtatgatcaagtttaagcgcttggtgagcggatgtttgcgttgccgaatcaatctgacaataccccatatgagtcccactagcccgagcagcacaaaaatacttcccagtgttgacatgttattccctccaaagttttaatatcgacattagttgtttaaacataataagttttttgtcgattattccaaggtttattttcccagaaaaaaagcccggcgacaagcaccgagctagcttcacagtcagtttttttaggatttgaccacatcgacattagcatacaagtttgcaatgatcgccagcatgtctttttcagtccggtcccagccgatcgttttaagaaaggcttgaccattttggacttggttgctgatcgtgtcagggttggcacaagcatttgcaagcgttttggccagatctcgttcatcaaggtgactggcaaaataggtcccgtctttcaagaagtagcttcctgtgccttccttaaaatcaatgagaggcaggccagtgctcatcatttcataagggacaagcgaaaaattggtcatagatggcgcgatcccgaaatcagcactttggtaaagtcgatttaattccgggggagtcagcttaccaaggttttcaccattgatgaatcgtttgctgcggccggtaccgaagtattgaattttgagatcgattcctttggcgcgcagtaactggcggcaattttcgaggacaatctgaatgttgatgggtgcgcgccgcgggctgctccacttggtatagacagcaagcttgatttgttttttttgttcataaggtgtcatgtcgcgttccttgaatggataccgtgcaacatcgacaggaaagttaatcacatcaataggactgtgaaccttgcaatgcatggtgatcatgtgggcacaccatggaccaagcgataccatgtgcagacctagactgtaagttcgtcgcgccatctgatagcgatcgccatatggatagaaatacggttcgtaatcttgaacaaaatacattttgtaccccggtttgttcttgatcacataaacggattcccataacgtggcgacccaaatatcggaacgatgggactcaagttcgcccattggcagacaggttcctttgtaaccgggataattaaattcagcattctgaatcatttcgtcttggctttgtgggacatagcttaaatagtagacatcgtaaccggcgttggccagcagcgtacctagatgcagcatcgttgtttgaccgccatcaaaaccgataatgccggttgtgacaaatgtgatccgattaccacgcggtttcgtttgatcggctggttgatcattaaaatatttcaaaatctgatcatattgatgaatactgccatcaggggcatcactaaacttagtttttgcaggtttcacaacgagtcctccttgtatgattaatggtactttgtgtcgctttaggcgtcgcttaaatttgagtagaaaaaagaagagcggactagttgtcatctcgcgtttggtgtgacgatccgtgtaggctcaagaagcgtacaaaagcggctactttattttagtttacataataaccgtaaacttctttttgaaagttttcaagttgtcgctgaatggtcgttaagaacggagaggcgtaaaatagaaggacaggaccagtggtatactgtgttaataatagtggcatttggttaggcaggcggatcattacgaatgcttatctttaccctgacaggggcctgtgctagtgtgaaagtaaattattttgtcatgaaagaacaggtgaaacgatgttaacgattggtgtcatgggacttggtacgattgcgcagaaagcatatctgccagtttacacacaaatgcagaatcaagtgcactgggtactgagcacccgcaacgacgataaattgcaacaattggcaacacaagacggacttgcgattgcgggcacgactttagaggatttggatgcgcaaccgctcgatgccatcatgattcacacgccaacggaaacccattatcagtatgtgaaacattttctggaaaaaggcgtcaacgtttttgttgataaaccacttgccacagatatgggccaaatcaatgaattatatgatttagccgatacccagcacgtgctgctaacggttggattcaatcgacgatttgcgcccatgattcaggacttggctgaagtcgatgataaaacaggcgttcgcgttgacaaaaatcggattgatgcccctgacgatccagaacatgcactgtgggatctctttattcatccggtagatacggccttaatgttggcaggctatccagaaaaaccaaatacccgatattcattgcataccggcgatgatggtaaactgcagcaagctagtgtgattttcaccgcaccgggcatccgcggtgaagccgggattgacttacaagcaggtaccaatcttgaagaagctcaggttgcggctccaagtggcgttcagcgtgtgcagaatcttgatcaactcgtcgtttacggacgtggcggggcaacgcagacattcgcgcctgattggcagccgatgttaacaacgcgcggttttcagccaatggttcaggcctttgttcaggctgtggcggatccagaagggaaaaacccggtgtcaccagctactagtcaattggcgcacgcagttgttgcggatttggttaatcagatcaaggcttaagttgtcgtggattttgggatataaggcatctaatcattcggatgccatcaagaaaatgctcgctagtgaatttttggcgtggtgagtactgtctttttggagggaatcgcttatgtatcgaaaagaatttatggcaatggccaatgaagaagccaaggcaaacgtcaatggtagcgatggcggtccgtttggttgtgtgatcatcaaagatggtaaagttgtcagccgcgcgcataatcaagtgctggttgatcacgacccaaccgcccatggcgagatcacggcgattcgaaaagctggccaggcacttggcacacatgacttaaccggctgtgaactctacacatctgccatgccatgtcccatgtgtctcagcgccattatctgggccaacattaagcaggtatactatggcaacacagcagacgatgctgcggcaattggctttcgcgatgccgctatctatgatttcatcaatgccggcttgaaaggcgacatgcttgctctgacccaacatgatcgcgagttgacgatcggggcattcaaagactatcaatcggctcaaaagaaactttattagcaacacgagtggcatcatctatcattagccaaaatgactgacaggaaaaagcgaaaacccgcatcagttgacaccaagtgctgtcaaaatgtatttgacattttcgcactttcctgtagaataatttaggtacgatattaagcgccactcattgcccgttggtcaaggggttaagacgccgcgttctcagcgcggaaacacgggttcgaatcccgtacgggtgagaaatagaacaaataagaacaaatgaaatcctcgaaatgcctttagaatggtgtttcgggggttttgttttgggagaaaggactaaaagggataacttagggggcattgatcggggactttcacgaacaagtattcgtggaaaaaggcaaatccccctgaaacgtggaaactattgtgcctcaagggttttgggcggtgataaatgcattgagtttttagaagtcccctaatgatcgctgaatccagcgtccagcacggaatgtggcgaccgatgatgttttcagtcttttgaaggcatttttactactttgtccctttttttccaagatactcttgaccgattgacacccgcaacttggtgtcagcttcggcctgcatttgcgtgaagacatggccgtacatgcggtgaagttcctttaaactggtgtaaccaagacgcttcgcaatataccagtcagagtaaccagcgtagatcacacaaatttaaccttaaagttgacaaaaaagtcactgttgatacattataaatattgaaaagaggccatcgggagggtaccccgatgacctcgacacggtctggaagactggtgtagaagctaaccctcgtggctagcttcttttagtatcttagttgcgtagttattttaaaatattggccagcaagccactaattcatcatcgctactcctaacgtcaaataggtagcgaataaaatccaaacaaagtatggcacaaacaggtaggctgccagtttattcacattgcgaaaggcgagtatgcaggcaaggacaaccaaatcaagcactataatgatgatcagtccgagccaatagctattgccgccgaaaaacacgatgctccaaatgaagtttagaagcagttgactgccaaaaagactgagattgatggttttttgggtacgcgatgtcgtgtctttgatgactaagtaaccagcaacgccaattaataagtagaggatgatccatactggtccaaagacagcggctggtggtgaaagtggcggcagctttaaggatgtatagatgcccctgatattacctgcgagtagaccggaaagggacccaataagctcaacgacgacgatgctcaaaatgagatgaaaccagttgatatttctttttgtttgcataagcaattacctccttttttgagtttagcatgctcattattaattgtgttaatatcacgcatttgataaggcgcgtcaatcattgattgtcaaaggctgttactgatccagaaactgccttgacataagttctatgataaaggtagagcctgcttgaaggctttggcaggccagaagtttgattaagcgaggcgatcatcatgatgcaatatcgattacaattagacactaaaaaccagttgtttgtagcaattgacgcacatgatcagaaccattttggaactggtcggacggttgaagaggctattaagaacttgaaggattcaacagacaacaaagctgcataaaatcaggtcgtggactttcgcacttgcgagaacccacgacctgattttttagtggcgcttattttcctaaaaggttcgtggtaaggcatcttctagtgcattcccaattcaattcgtcagacaacgccgtagcttttcgataaatggatttaagcctgcgtttccaagtagttcgattcggattactgatatcgcaccaatcgccgccgagttcggatccaaacaacgataagcacagcgactagcgcaaacacaccgactgcggcaatgatgaacaaactgcgatagctgagccagtcgatgattagcccgccgaataatggcccgagtgcgcgaccaacggaaccccaagaattgacgaaaccttggtagcggcctttgatttcacgcggagtcagatcgttaacgagtgcaggaatagcaggggatgcggtcgcttcgccagttgtcaaagcaatcattgcgatcatgaaaagcgcatatgtgtgcgcggtgatcagaatgagaaatgagatggcaaccatcacgagaccaaaaagaatttgatagataatctgaatgccgttgacgtgttcgttgaaccagtttaagaagagttgaatgacgacgattaaagcggcattcaaggtccacaggaaactgtaattgcgtaacggaatgcctagtccagtcatgtagacggacaaattggatgaccattgttgatacatgagccaaaagatgagcaaggcaaaaaagaaagtggtcaacatcagcttgtttgcaccaggcaaactcggctttggtgtttcggtcgtcgtttcttttcgtgtcggttgcgctgtttttgccgccggtcggaatttgattagcacgatcccaaagaaaatgccatataacacaaccgcaatcaaaaaaagtagggtaatgctgatatcataaacaaacccaaccaacgcagtgccaaccacaacaccgacattttgcgcaaagtagagcatcgtgaagacatagcggccgtcttttgaccggatgcttgtgccgagtgaattcaccatcgtaatgttccacccggagccaatgcccagtaaggtcagccaaatgctgtaggctggccagccgtgccacaaggtcaaaccgatcaagaccaagccggtgagccccacaccaaacaaagcaaggcggtaggggtcgccttggtcgtacagacgtccgccaatgatactgccgacgacgctcccaagcgaatttagcagtaaaacgacaccgatgacagttagcgaaatgtctaggcgattatgcaaataaatgctggttaaaggccagatgaaactcatgccaatgctactaagtaaggcacctgtcagtaaccagcgtaactgaatttcgcgcaccaagggtaacgccccctttttaaaataattgcaaggcacggagccgcttgctgcctgtgtttaagacaataatgccatgttacgtcaagtgtgatcgggcggtcaaacctattttgggggatgctttcatgattgaaaataaacgcagacacattttgtgggtcagaaaaggaaaagaatagggacttggcaacatgtcccaaaaccttaatgcatagcaggcaggcgcatgcgtaaataagcgatgaaatggaagacgataccaagaagtagcaagacgccagcgatccaaacgttcagccaactgaccaaaatggaactaccataaattaagccactgattaacggatcgatacgttgtgtaggactggtgatgccatgatcggtgagttgtggatgggtgcttagataatgataaatcaaccaataagaaagcgaaattaagagagcgacaatgtcgtagacaataaacgctacctgcatgtcagcatgattcaaggttcgtaacgccattgcaaccagtgacatgctgtagttgattaacgttgcggtgaataacaggatgagattcaaaatattcagcgccgtggtggttctcttaacatgagtaaagtagtcgtggtggaaaagccacaaggtaccgacgtaaaaataagaggtgaggtaagtgattaataatggcatttgtccggttacttggtgcaacagcgtccctggtcggccagcaacgggatgaaattcaagcaccaaaatagtgattaaaatggcaaacacgccatcgctaaacgcttcgatacgagattttgacatagcgatcaatgcctccttttgattgccatttgggtgaggtatgccggatcggttgtaagaagttgtcagcaaaaaagcggccgcaagattcggaccgcttgatgtcattcgcttataacttaaagatttttatccatattaaacgttaacttcgacagttttaaactttccatgacatagttgttaatcaaagctttagtagcttgcttggtgtgatcaactaacttgtaattggcttcagttaaatactgcgtcaactctttatccccaagatccttggcaccgtcgtcggtggcttggatcatttcacgatagtcacgattcagggcagttaaataatcgcgatctgcttgaataaactgggtgtaatgcgcttcgactaacacatccaagaggcgatgcagccagtaagctgaatcggcatcaatatcgaatgttttcggcgttttagagtagcttggatctgtatcgttggcgttgcaataaaacggtacatacggactgaaagtcggcatgccaatcgctagccacataatggcagcaagtccttcattgacatcacggcgtagctgcaaaatgtgtgaattttgcgtacggttcaagccgattggccggtaacggaaacgatcggcatcactaccatgaccataaggatcaaatggtgtctcgttgtaatggctgccgaggatttgggcaatgtcttcacggttgatcaggtgatcggtatgcatgatgaatggcaattcggctgattcgggatcagcttcgatttctggattcagaattttgtgaccataccacacacgcggcgtgttgtagtgacgatccttttcattcatcgtgccgaaaatgtggcggaagttccaaccttctttgtcggtgttcaggtgatgcgcatcgacgaattcttgaataccttcactccagacaaaattgtcggtatcatcaaagtcaacttgctggatagcaacctgattagcagcaatcgcgtaggcatcatcagggatgcgctgtgcaacccaatgatggccagtcacgatttccatataccagacattatctttgtcggaaaacaacaccgagttgccagcaggagagccgtattgcttgatgagttgacccagatactcaaccccatgacgagcagattcgatgaatggcagcaccatgttgacgatcaagtcttcatcaagcccatctttaaccaacggatcaaaccccaacgcccgttcattgccgtaagtgctttcggtggctgacatcgcgacattgcgttcgttgatcccgctttcctcgtaatcaccgagtttatcgttctcaacatttgggacagcattatagcgatagccgttctccggcaagtctgcttcgaaaccgttcaaaggtgatttaacgtgcagcgatttctcgcctttccagcccgcgtgcatatagaaacgttgtggtgttaggggactgaaggtgtcgtcgttacgtgcgatcatcgttgaaccatcgatgctggccttcttaccgaccagaatcgaggtgcatgcagattcaattttcattcttgcgcctcacttcttaagtattggtaatagtttacgccagaatcaggtattttgcaccttcataaaaaaagacgttgacaagtgcgcaaaaattttttaagatattactcgttgttaagttattgggtagtagcgaagtggtaacgcagtggactctgaatccataatcataggttcgatccctatctacccaagcgcgatattaaaagatgctgtgaacagacatacttgtttgttcacagcatctttttttcgtctaaatcattttaatcccggttatgagcgctgggtccaagctaaaaaggcagcgtagccaaaacaaagacaaccataaagcagaaaagcgccgatgatgaaggacagccatggccaagttaaaaaagcgcgtgcgatgaaaaggaagaaagccatcagcaccgcgcgcaggccacgggtgaagacggctttgacagcattattcaaatgacacctcaatgagcaggcgccgtgccttggtcaggtggctcgtggttaaccacatattattagttgaagcctgctcagcgtcttcactcaattcaggcagcaggcttaataaccatgcgcctaactcaggattattgaatgcaaaatgttctggcaaacggataacccgtaaccgatttggtgggaaaaagagtgattgttcaggaaacaacacacggtcgtctaaaagaatactggcgacattttgataaggtaccgtgcgaacctgataactttgcggatgggcatgggcatatgccagtatcatgatggctgcgttgatcacaaaaaaggcctccattcagaaatgcttacgggtttcatgataccatggaaaggagaagtgtgtgcgttaagcgagaatgcgcactggacagtcacggatgcgacaatgatgatgagatggcataggtgcacggactgaaggagtgatagacatgacgataaggctatatttggttagacatggcgaaacgcctatgaatgcggcacgacaattgcaaggcatcacagatgcggcgttgacggctaagggacgcgccgctgccgaccgattaggcgagttgctacggccagtgccttttgcaaaagtctttaccagtgatcgcggcaggacaattgaaaccgctcatcggattattgctggtcatcagccgcaaccgccattgattcaattgtccgccttacgggaatattattttggcggcttagaaggtgattctggtaacgccgtcatcacccgcacgattcgtcaatttggggtggctgccgcttttcgggcttggcgcgggtcggagcgttttgctggactcgtgcggtcaattcgagaagcagatccgacccatcaggcagaggacttaccagatttgattgctcgtgcccaccaggcttttacccaagtgatcgcccaaagcccggataacagtgacattctagttgtttcacatggtatgttactgagtgcgttgatttatcagctggcgccagaggacttgccgtttatgctgttgaagaataccagtgtgacgcgggttgacatcacagagaagcagtggcaggtgcgcggcgttaatttaactcgtgaacgcgacattttggcacttcgcggctcagcaacatcaacggcacccgatgctgcctcggatcagtcgccaaagtgatttcttggactgaatggttatttaacagcaaccagtcatgttccaataataagaattttgttaaaacgacaacctcagaccttcgactgaatttgtcgttttttgattgcattttaaaacaaccgcgactataatgacagcttgtcacatgacaaattgtcatatccgtgaaaggaggccgtcatgccgaaaccaacgttttttcggttaccggaagcaaagcaaaaacgtctaatggatgccgctaataaagagtttgcccgcgcaccatttaatgatgctagtattagtcatattataaaggatgcagggattccgcgcggtagttattatcaatattttgatgacaaagccgatctttatttttatttattggaacaagtgcggcatcgcgcagttgctgctttgcaacaggtgatggccaaacatcacggggatctttttgccgctatgtcagaattttttgggctgacgattgatgcgctggttcaaggtccgcatgcagcactttatcgcaatgtctttttgcatatggatttccacagtgcctcaaaaatggccggatcacctttagctgagcggccccgtgggcatcatgagattcatcagtatttgctggcaaatattgatcgtcgtcagttacgaatcaaaagcgacgatgatgtcagtttgctcattcgtcagattgtcgggatgttcatgcagacaatcggctatttttattcacgccagactaaaggtaaagaggtgaccgttgctgagttgaagcaacgcaccaatcaaattctggactggttgcagtacggcgttgccagtgaaggggaacgtcattaaattgtgcaagacggtcgaccgcaattgcgatctaatgcacgtgttaggaggaaattatgcttaagcttgcaaaaaaacgcatgtctggctgggccgtcatcggcgccgtcctgttcatgatcgttcaggtgatgagcaacctgtacttaccaaacttgacagccgatattgttaacaacggggttgccaaaggcgatattgattacatttgggcaaccgggatgaaaatgatcctgtttgccttgctcagtattcttgcgagcgtgggaaatgtttttcttgcgtcgcagacatcgcaaaaactgggacaaaaattacgttccgacgtctatcgcaaggtcattaactattctcatgatgagatggacaaggtcggcacaagctctttgatcacccggacaacgaacgacgtcacccaaattcaaaatgtttggatgatgatcttgcgaatgatgatcatggcaccaatcatgctcatcggggcaagctttttggcttatcaaaagagtcataccctgaccatggttttcttgattagtctgccattattagcctttttcctattgattattatgtattttgctgtgccgttgtttaaggctatgcagaagaagaccgataacattaacttagttttccgggaagggttgactggcgttcgggtcattcgtgccttccgtcaagatgattttgaacaaaatcggtttgaaacggttaaccaagattacacgcacaatgccgtgaaggtcttttcaatcatcgctgcggttttcccagtgatgacgttgattatgagtggcacgaacattggcattacttggtggggcggccatttgatcgcgcaacaagcacttgaaactgggaatctgattgcgttcatgacgtatgcaatgcagattttaatgagtttcatgatgctttctatgatctttgtgttcattccgcgggcgcaggcttctgcggttcgtttgaatgaagttttggatcaacatagtcggattacgacgccaacctcaccaaagtcgttagacactactcatcctgcactgcagtttgatcacgtccaattccgttatcaccatgcggaagagccagccttgagtgatattgatgtgcaggtcactggtggtgagacgctggcgattattggcggaaccgggagtgggaaaacgacgatggtcaatctgattcctcggttttacgatgcggaaaaagggcatgttcgagttgacggcgaggacgtgaaagccgttgatttgaagaagctgcatgaagctgtggctttcgtaccgcagaaagccaatcttttcaccggaacggtgcgcgataacatgaaatatgggaatgatgaggcaaccgatgatcaaatctggcatgcccttgaaattgcccaagctaaagatttcatcgcggccaatccagaaggcctggactatcaagttgaacaaggcggcggtaatttctctggcgggcaacgtcaacggttagccattgcgcgtgctttggtcaaggatgcatctgtttatgtttttgatgattcattctctgcgctagactttaaaaccgatgctaatttgcgggccgctttaaaggccgatgctaaaatccagacaaaagtcgttgtcattgttggtcagcgagtatcaaccgtcgccgatgcggacacgattgtcgtgttggatgaaggtaagatggtcggcaaggggacacatgctgagttgaaggccaccaacacgacttatcaggagattatcaagtcacagattcgggaaggagacgagcaataatggcagatcaaaaaaagtctgaaaccacgaagcagccgtccggccctcggatgggtccaggcggccgtgccggtctcgttgaaaagccgaagaatttctggggcacgacggcgcgtttgtttggttacatgcgcaatcggctgattgggatcattgccgtactggttttggcgattgcctcaaccgtctttcagattcgcacgccgaaaattttaggggaagccacaactgaaatttttaaaggcgtcatgaaggggcaagctgaacaaaaagctggcatgtcagttggcacttatccagttgattttgacaagatcaaacagattatcttaatcgtcctagttttgtatttgggcagtgcactgttcagtttcctgcagcagttcattatgacccgaatttcgcagaacacggtttatcaactgcgaaaagatttgaagtacaagatgaaaactgtgccgattaagtattacgacacgcacagcaacggtgatatcatgtcgcgggcgattaatgatatggacaatatcgcctcaactttgcagcaaagtctgacacaaatggtgacaagtgctgtgatgtttgtcgggacgatctggatgatgttgacgatctcttggaaactcacgctgattgctttggtgacgattccgcttggcctgattgtggtcgggatcgttgcgcctaagtcacaaaggttcttcgctgctcagcagaaagccttagggttgctgaataaccaagttgaagagacttatggcggccaagtcatcatcaagagtttcaaccgtgaagacgatgaagtccgcgattttgaaggtcagaaccaagccttttataatgcggcttggaaagcccagtttgtttctgggattatcatgccgctcatgatcttcctgaacaacatcggttatgtttttgtagcaatcatgggtggtatcgaagttgccaacggtgccattacactggggaatgtgcaagctttcctgcaatacatgcaacagttctctcagccgatttcacaattggccaacttggctaacacgattcagtcaacgattgccagtgccgaacgaatctttgctgttctggacgaacaggacatgcaagacgagccgtctggtgtgccagcagtcgcaaatgatccgaacaaattagtgatggatcacgtacaatttgggtatacaccggatatgctgctgttgaaggattacaatttgcaagtgaaaccagggcaaatggtggccattgttggaccaactggggccggcaaaaccacaatcatcaacttgctggaacgtttctacgacatcagtggcggttcgattcgcttgaacgggacagacacgcgtgatatgaagcgagaggcagttcgctcgcattttgctatggtgcttcaggatacgtggctgtttaccggtaccatttgggataatttgaagtatggtcgagaagatgcgacagacgatgaagtgcttgcggctgccaaggcggcgcatgttgataactttgtccggcagttgccagatggctataacacgattctgaatgaagaggcttcaaatatttctcaagggcaacggcaattgctgacgattgcgcgtgcgtttgtcgccgatcctgagattctgattcttgatgaagcaaccagttcagttgatacccgaactgaaattcatattcagcatgccatgaaccgactgttgacgaatcgcaccagttttgttgttgcacatcgactttccacgattcgcgacgctgacaacatcatcgtgatggatcatggttcgattgttgaaaccggcaaccatgatgaactcatggccaaaaacggcttctacgctgatctgtataacagtcaatttagcggcaatgttgctatttagggctgatttgtagggacgagcgtgagccataatttccttgtaggacttgtgattcgttaaattccgaataatcgtaggcgggtgctaggctaaaagttccttgccgtgccaaacgccgcaatctccggccagatggggtggcgacgcgtagctagagcagtgacggcgctttgagctcgcaaaaagcagcgcgatctcaaagtcgcctaacaacatcagctccaaggaccgtcgctgtgttgtttccacggctgagccccatctggcctacgattgctccgccttggcactaggatttttaaatttttcctgactatctatgaaaaacaaagacgactgattttccgcaattgaaaatcagtcgtcttttgtttggcaatggtgaacgttgaaacatcttaacttttcagcgccgcttgtggcgcatgaaggtcgcgtagtgcagtaggcaggctaacagaacaaagaagattaccacgaagctgacatagcgccaccagaagttggtggcgatgccaggtaaaagtaactgaatgcccatcgtcgccagcgccatcacagcaatcatgccgaataataagaagtatcgtttcacggtttcatcatcctttttcttaaatgtgcctaatttttcgccgagttggtgggcttgattgacctttgccagtggcagtgaggtcatcccccaagtatgcggtaaaaccagttcggttattttatggacacctgctgctgtcatggctttgtcaatcgcaaccaaggtcgcatcggtttggtgcgtgaacgtattgtccaagccggtggcaaaacaactggtgacactgacataatgcttgtccttaaattgcccaggcaaggtgtcacctttatgagtcattcgcgtcatgcgatggcgcatacagtctagcagttgcttaaattgaccagcgacagtgccaaaataggttggtgtacctaatacccaaacatcagcagcttttaatttggctgcgagtttatccagcgttggatttgtggtctcaggtttgtcaggatgaatttgatattgattcaaatcgacaaactcagttgtggcgggcgctgcaacgccggccaggacttctttgactaagctggcggtgaggccattagcatcttgaccaccgtatatccccaaaattttcatcaaatacttgcgcctttctatgtcatgtttttacatgacgtcacacttaactctaaaaaacatttgtgaatttcgcaacttagttttgttgaagaagccgactttcgcgatggccagcactttttgagttgacttgcgaattgaatcaccaaatcaagcgttttgttggcaaaaattgaaccgaatcattatgctgttctcagttatgtaaacagcgggagatgaacgctgtttgcgtgttcaagaaggagcagattaaaatgacaggaatcatattgccagaagagacgcgagtggattttgtcgcgcttaaagtggcgaatttgacgttggtgagtcaatggtatcagcaggttgcgcggttagatctgctacggcaaaatgggtcaacgatttatttaggtacccggcttaatcaacaggttttagtggtgttgcatcaaattacagggctgcaggcacaacagccggtgactggcttggatcattttgccattttgttaccgaatccaggtgccttaggttcggcttatcgcattgtggctaaggatcaaactgtaatgaccgcctttcagacaggttaccgggaaggcttcattgcccatgatcccgaaggcaacggggtcgctttcaccattgatcgcgcgattgaacagtatcaagaagaacgacaatataactgggaagacgaaacgcttcagtcgattgacccggcaaccattggcaaacatgccgctcgggaatatgatcgattgccatctggtacgacgattggttatgtccaatttcgggtgtccgatttaccagcgacaagtcattatcttgaacagggattgggttttcgcgaaaagactagccatgatccaaatgaggtttttttagcggcaggggattatcggcaccacattggcattaacttaagactggatgctaagttggcgttgccgacgccggatatgtatggtttggattatgtgagttttatcttgccagatcagcacgctatggaaaacattttgatgaaccttgatgcggcaggtttaacggattacgattataataaagacaatcaatttttgatgattgctggtcctaatcgcctaacgctgtggtttcgggtggcgtgattcgtgataatggtcagtacatcagagagaaggccagcatggattttcaaacagtgacggatgaactgaagacatggacaaaagcccgggtaatgccgggttttagtgtggcattattgacgggtaaaacggtgcagacggcggtcagtggcgaagcacagtggttcccgcaacctgcgcctttgcagccgcatatgctgtacgacgtggcatctttgacgaaggtgataggaactaccacggtgttcttgcaagcatgggaccaaggcttggtttcgccggatatgccgctacaccgattcttgcaagatttcccacacacaaccacttttcgacaggcactcacgcatacttcaggactggaaggctatattccgcaccgtaatgccttgccagccccggcgctgaaacaggcgttgatgacgcaactgactgttaccgaagaagtggatcgtcaagtggtttatcgcgacgtgaatttgttgctggttggctgggctttggaacaggtatatcatcagccaattcaaacactcatcacgcggcaagtgatacagccactagccttaccgcaagctacttttcaacctgattcacaacaatgcgttccaacaacgtatagtccggcagtcgggttgcggcaaggcgttgtccatgatcccaagagcgccattcttggtaagcatagcggtgcagctggcttatttgcttcgttggccgatctagtaactttcaccgaatacttttttggcaaccgccaatcagcaagctggcccgcgcatgcggctgatctcacacaggattggacaaagcatcacttaggccgcagtctcggatgggacttgcggcgcgatggtcaaggccgactatggctttatcatactggctatacgggcactttttggctgattcaacctgatgatcaattggcattggttgtcttgaccaatcgggttcacccccaaccaaatccggcttttttggcaaagcgggatgctttgatagcccgatttttaagtgatttcaaaacaatgcctgctgtataactgataaagttttgggacatgatttatagttgcaaaaaaagacgagcgattgtccgtagtatttggagtacggaaaaccgttcgtctttcattttgttatagacaatctgctgttgaatttaaagatcccagtgctaaggcggagcaatcgtaggccagatggggcccagctgtgcaaacaacacagcgactgatctagttaggcgacttcgaaaccggtttttgggctcgaagcgccgtcactgctctagctacgcgtcgccaccccatctggccggagattgcggcgtttagcacggcaaaggattctttgcctagcattccttcccacactgtcgtagaaagcatacgcggcctaaaagcctgctttgatgtacccgccatcgcttaatttcttgcgtagttgcaacattgctgtataggtggccagaacgtaaagttgatcttgcggggagcgttttaaggtgctgatgacatcatcaagagctggcttgctgacaagcgctttttcgggcacacctgcgactgtaaggcgtaaaccgatgtccttgtagcgttcgccgccgaccaaatagctggcggccttttgactggcaacgagttcttcaaaattgccgtcccaaatccaactagtatcaatgccatctgcataattggcattaagcagcattgcaaaaccaaacggctgcttggcggtttcgatcatgctgaggacctggttgaggccgactgggtttttaaccaaaatcaaggttaattttttcttgccaagttgaatgacttcttgacgaccgaagaccttttcgtcataagcaaaagcttggctgatttcagtcggggtaacaccgaacgcccggccaacagcaaaggcggcgagcgcgttgtagatgttatacatgccaccgatgtcgatgtggcatggttgatcatcaatcatgaagtcgctgctttgtggggtcatttgggtgacctcggtgatttgatgggttaaagcggggcgtttgaagccgcaatgcggacaaaaataattgcccaaattggcgtaagtttgtgcatggtagtgcagaatgtgctgacataccggacataagacaccgtccgtattcggcggggctttatgatcgccatttgccgtgagttcaaagccatagtaggtgactggattaggcagctttcgggagctgaaaatcggagcgtcgccattagcaatgaccatcgcttcaggatcgcgtgtcacaccgtctaaaattttctgataggtggtataaaattccccataacggtccatctggtcgcggaaaatattggtgagaacaaaggccttgggttttaactgagcggcaactggtgcaacattggcctcatcgacttcgagcacagcgataccgcggccatgaccgcgcttcggctgggccaaaaaagctgttgtgataccttgcaacatgttggagccagtggggttcgttaagacttctttatatttctttttaagcaccttaacaatcaggctggtggtcaacgtcttgccatttgttccagtcaccacaataacatcgtagttttgaccgagcgtccgcaagacttggggatcaattcggttggcgatctggcctggtaggctcgacccgccttttagaaatgtgtgtaagaaccagtaactgctgcgaccaatggcagttgccaggctagcttttgcagaaaatgccacggcgttcttcctctcaacttaatgggactattttagcataagttgcaagcaaaccggcgggcgtggtgttctttgcacaaaaaatccgttatactgtgagctgtgatatttgagatggaggcggcatatggcccagcttttctttcgttacggtgcgatgaactccgggaaaagtattgaaatcctgaaggttgcgcataactatgaagaacaaaataaacgcgtcattttgatgacaagtgccgtggatgatcgtgccggcgtcggtatgattgccagtcgaatcggcttagaacgcacggcaattccgattacacacgaaactaacctttacgacatcatcaaggcaactgatcctaaggcagcctgtgtgttgatcgatgaggcgcagttcctgcagaaacatcacatttttgaagcagcacgtgtggttgatgaattacatattccagtcatggcgttcggtttgaaaaatgatttccgcaatgagctgtttgaaggttcaaaatatttattactctatgcggacaaaattgaagaaatgaaaacgatctgctggttttgtgccaaaaaagcgatcatgaatttacggattcatgatggccagccagtttacgaaggcaaacaagtactgattggtgggaatgagtcgtattatccagtttgccgacatcattattttcatccgccattgaagcagattgaccccgccgattaaattttaaatggcgcttgacgataagtgcccgcactggcgcgtttagcgactaggcgtgtcgattgtgacgccggtaaatgcatttttaggaggaaacatggataagatttttgaacagttggatggtctgctggaccgttatgaagaacttcaggagctgatgtcagaccctgaagtgattagcgatacaaagcgttatcttgccttgtccaaagaagaaggcggcatgcgggatgttgtcgccgcttacaagaaatataagcaagtgctttcagatattaaagaaagtgaagaagttctgcgggaaagcaaagacgacgacatggaagctttggccaaagaagacctcgaagacttgcagaagcaaaaggctgaccttgaagatcaaatcaaggtactgatgctgcccaaggatcctaacgacgataaaaatatcattatggaaattcgtggtgcagcaggtggcgacgaagccagtctttttgctggcgatttgttgaatatgtatatgcattacgctgagcgccaaggctggaagaccgagatcattgacgcaactcctactgaagtcggcgggtacaaagaggttgtggtcatgattactggggacaacgtctactccaagcttaagtatgaaaatggggcgcatcgtgtgcagcgcgttccagtgactgaaagtgctggccgcgtgcataccagcactgcaacggttggtgtgatgccagagtacgatgaagttgatctaaaaattgatccaaaagatattcggacagatgtttatcggtcatcaggcgccggtggtcagcacgtcaataaaaccagttcggccgtgcggatgacccatattccgagtggcattgtggtctcaatgcaagatgaacgtagtcagcaggaaaaccgggcccgcgcaatgcagattctgcgttcgcgtgtttacgattattatgaaacccagaatcaggaaaaatatgatcagaatcggaagaatgcgattgggactggtgatcggtcggaacgaatcagaacttacaactacccgcaaaaccgggttactgatcatcgaattgggttaacactcaacaagttggatcgtatcatgaatggcgaactggacgaaattatcgatgcgttgatcgttcacgatcaggcacaaaagatggaatcgctcaatgtctaaaacgtatgccgaggcgctcaagtgggcgtctttgttgttgaccaaggacgggattgatcctgacggtgcgcggtatgtcttgatgacacgcgcggacttcactccaagtcaattgattttgcatcgtcaagatctgatgcctgaaacacgttggcagcaatttcaacaggatgtcgaacgcttgcgtcagtttgagccggcccaatacattgtcggggtagcccctttttttggtgagttgtttaaggtcacaccagcagttttaattccgcgatttgaaactgaggagcttgtggcttgggtcgctgaagagcaacggacagcacaaactggcttggatcttggtactggcagcggggcgattggcttaaccttagcccgcaagttgccgcaaacaacgatgaccttgagcgatgtttcaccagaagcacttgcggtcgctaagcaaaatgctaaggaacagcaggtggcagttcagtttacggtgagtgacttgtttgcagccctaccagcacggtatgactttgttgtgacaaatttgccttatatcgccccagaagagacgcctgtgatggatcaaagcacgctgcgttatgaacctaagttagcattatttgcagggcatcatggcctcgccgtttttgagcagtttgttgcagcgttgcctcagcacttaacagctggcggggcggcatacttagaattcggttatcgccaagagccggcattgcgcgaactttttgctaagcaactgccacaggcgcaggtgacttttcgacgcgatatggcagatcatcctcgtatggccaagctgcaattctgaaggttaaaacacatggtgtgacccttgaaccgatctgctacaatttttctactgagtttgagctattttaaaaagaacatgatttggaggcaacatcttgtcaaaacgttatcacgaatctgatattccggaagctgcggctgcgctgaagcgtggtgagttggtggcctttcccaccgagactgtttatggtctcggggcggatgcgaccaatgtgacggccgttggaaaagtttatgctgctaaagggcgaccgtctgataatcccttaatcgtaacggttgccgacgccgatatggtcggacaatatgccacgattaccccgcttgcagcaaagctgatgcaggctttttggccggggccactgacaattattctgaatattttgccaggtcggctgtccatgaaggtgactggtggcttgcagacagctgccttccgaaatcccgataacgcgttaacacgcaaattgattgcgacagccggcgtacccattgtcggtccatcagccaatacttcgggcaagccgagtccaacaactgctgaccatgtgttgcatgatcttgacggcaaaattgccggtgtactcgatgacgggccaactcaagtcggtgttgaatcagcaatcattgatctcacggtcacgccaccagctattttgcggccgggagccattggacccgatgaacttgaaccgttaatcggacacgttgatacggcagcacatcatgttggccaaaacgaagcacctaaggctccaggaatgaaatacaagcattatgcaccagctgcgcaagtagttgttgttgatgatccagcccaattttcggcagcggtcacttgggctaaacaaactggtcaagtgtttggcctgttggcaactgatgcaattttggctcagtatccgacgataccaagctattcacttgggaaggatgttcaaagcgctgcccacgctttatttgccgggttacggtggtttgatttacatcccgatgtcacgctggtcttagcacaagctttttcaaaaactgaattaagtgctgcttacatgaatcggctgttgaaatcggctggcgatatgcattttcaaggatagtcacggcgaatcatagcgctaaccgtttatgagtgctggactatcgaggactcaagtttagccgtcgtgctgaatcgttatcttggatgatggcagctgtttaaacgagacagaacgccaacattcagctacaaataagtagattttctagcagacccacgatgatttgctataatgagaccaactgacagagcctttgtgagttggtttttttaataaaagcaaatgcaacgggtgtttttgtggcgcattttaaaggaggaacttgcatggatttcatggcacaagatccagaagttttcggtgcaattcataacgaagaggaacgacaagaacataatattgaacttatcgcttcagaaaacattgtttccccagcggttcgggcggcacaagggtcagtgctgacgaataagtattctgaaggttatcctggccatcgttattatggtggtaatcaatacattgatgtggttgagaatctcgccattgatcgcgctaaaaaattgtttggggccgaatttgcaaatgtacagccgcattccggttcacaggcaaatatggccacgtatcgcgcctttttagaagatggcgataaagtgctggcaatggatctaaccgatggcggccatctgactcacggcagcccagttagttttagtggtcaggaatatcatttctaccattatggtttggatccgaagacagaacagctaaattacaccaagattcgtgagcaggctgaacaggtgcaaccgcgaatgattgttgcgggggcttcggcttatagccgcgagattgatttcaaaaaattccgcgaaattgccgatcatgttggggcctttttgatggtcgacatggcgcatattgcggggttggttgccgcgggtttgcatatgaatccggtaccttacgccgatgtggtcacaacaacgacgcataaaacgctgcgcggcccccgtggcggcttgatccttgctaaggcgcaatacggcaaggccattaattcagcacttttccccggtattcaaggcgggccgcttgatcacgtggttgcagcaaaagcagttgcattaggcgaagcgttgcagccatcttttaaaacatatgctcagcatattctggataacatgcaggcgatggtgagtggttttgaagaagatccgcatttgcggttgatttctggtggttctgataaccacatggtcttgattgatgtaacgggttatggcgtaaatggtcgccaagttcaagatttactggatgaagttggtatcacgactaacaaaaatcaaattccaggagagcagaatggcccgtttaaaaccagcggtatccgagtaggtacggctgccattaccactcgcggctttacagcagatgagagcaaacgagttggcgaattgatcagtgccgcgattgcccagcgtgatgatcagccagctttggaccagattcatcaagaagtgcttgcactgacagcccgtcatcctttatcatagttagggtttgcaaacaaatgattatcaaagaaaacgtgattgacttcttttgaaaccggtctatcagagggcttaggacgtgatgttcacggtagcacatggcggctaagacttttgtatagcggtttctaggatgaagaatgcgtttaggaggcgccaaatgggcaaatttacagttttgaatcacccgttgattcagcataagctgaccctgattcgggacaagcatgctggaaccaaggagttccgcgaaatcgccaatgaaatcgcggaattaatggtgtatgaaatcacacgggatctgccgcttgaaagtatcgaaattgagacaccgatgggtaaaactatccaaaaacagcttgctggcaagaagcttgcggttgtcccaattttgcgcgcgggtttagggatggttgatggtgttttgcgcctgattccagccgcaaaagtcggtcacattggcatgtatcgcgatgagaagacccttaaaccgcatgaatactttgttaaaatgccgccggatattgaacaacgggatttgatcattgtcgatccaatgctggcaactggcggatcagctaacatggccattgaggcactcaagaagcgcggtgccacatcaatgcggctagttgtcttggtggcagcgccggagggtgttaaagccgtccaggcggccaatccagatgtcgatatctatgcggcagcgttagatgatcatttgaacgaaaatggctatattgtgccgggtcttggagatgcaggcgacagactttttgggacaaaatgacattctttggcatgtgtaaaagcacgtgcctttttcatatttcttcaaaagaattttcatagccgcaaaaataggtggtcaaaagccgcccaaagccatgaaaacactgatgaaaaagccgctatggcggcaaaagtttctgctttcattgctttgtcttttaggtgaaatggtgttagagtaatgattgtgtttcaggggtctgccctagtaaacaacgattatcgaagtctccgcaatcgtgcatcatcattttgatgatacaaatgatatgacgtcacttcagtaaggaggtgaattctgtgaacgaacaatatccctcgatcaagctttttggcttaagctttaacctgacgaatgacatcggcgttttggtttcggcagttctggtattcttactggtattctggctgtctcgcaaccttaagatgcggccaggcggcaagcagaatgtgctggaatggatcatggactttacgaacggtatcgtcaaaggtaccatgcctggttcggagcgttatacttttaatttatttgcgtttacgctcttcttatttattttcattagtaaccaaattgggttattcattgaagtcgatatcggcaaagacacttggttccgttctgcgaccgcgtcgcctgtcatcacgatgacgttggccatgatggtactggtcctctcgcattacttcggggttgtcttcaagggtttcaaaggatatctcaaggggtatgcgtcaccggtcgcaatcctgcttccgatcaacctgcttgaagagtttacaaatttcattacactctccatgcggctgtatgggaatattttcgccggcgaagtcttagtcctgctcatcaggcagtttgctttctcaggcggggccgtcagcttcgtctccggattcttgcttgaggttctgtggcaagggttctcagtcttcattggtagtattcaagcgtacgtttttgtcacgcttgggatggtttacacatcacacaaaattgtgtccgagtaactaaattaggaggaaatttcttatgcaattcatcgctgcatcaatcgccgccggcatcgctgccttcggtgcttcaatcggtaacgggatggttatcagcaaaaccctcgaaggtatggctcgtcagccggaaatggctgggacacttcgtgggactatgttcatcggtgttggcttgattgaagccgttccgatcttgtctgtcgttgttgccttcatgttgatgagtcgttaatctggttcatcaataaagaagggagtggcaaaaaatgactttaggtgacacactcttcacactagtcacatttctggttctgatgctagccgtcgggaaagtggcctggaagccagtttcgaaaatgatggcggatcgtcagcagaaaatttccggagatctggattatgctgaaaagtcacgcaaagacgcagatgctttagcagctaaacgtcaagaagaactgcaacactcccaagccgatgccgttaagatcgtgaatcaagccaaggaaaatggcgagaaacagcggcaatcattggtcgacgctgccaacgcagaagtcaccacgatgaagaagaatgcgcaaaccgacattgatcaagcacgtaaagatgctttggccagtgccaaaaatgatgtggcagacctaagtttgaccatcgcgcaaaaactgatcggtaaggaactcaatgcagacgatcaaaaaggtttgatcgatgactatattaaacggttaggtgatgcaaatggcagtcactaatcagatggtcgcaccccgctatgccaaagctttattggaagcggcaaaagatcaaaatcaggtggagacggtccatgaagagttacaagcgctacagtctgtctttaacgacaacccaacgatcttgactatttttgataacgctcgaatcacggcagctgataaggacgccttgatgacaaccttaaccaaggatgctagcccgctggtcgctaacttgttgaagttaacccagcaatatgggcgattcggagcattaccagccatcatcagcgcgtttaaccaagcgtacgatgaggaagccgggattattgcggcgactgtgacgactgcagttgctttgtcagcagatcaagctgatgctttgcgcagtaccattgctgcgcgttttggcatgaaatcgacccaactggatcaagtcgttgatccaagcgtcatcggcggtgtgcgaattcaagcacgcggttcggttatcgatggtacggtcaagcaccgtttcgataagatgaaagctgcactgctggcagactaatgagtaagtaaaagaggtgaaccggatgagcatcaagactgaggaaatcagttctctgatcaaaaaacaacttgaaggatatcaggacgatttggcggctgaagaagtcggcactgtgacttacatcggtgatgggatcgcacgtgcgactgggctggaaaatgccatggccaacgaattgctccaatttagcaacggctcatacgggatggcgttaaaccttgaaacgaacgatgtcgggatcattatcttaggtgacttcgatgagattcgcgaaggcgaccaagtgaaacgcactggccgaatcatggaagttcctgtcggggatgccatgatcgggcgagttgtcaattctttgggtcagccggtcgacggtttaggcgcgattaagacggataaaacccgtccgatcgagtttaaggcgccaggtgttatgcaacgcaaatccgtatcagaaccgttacaaaccggtttgaaagcgattgacgcgctggtaccgattggccgtggtcagcgtgagttgatcattggtgaccggaaaaccgggaaaacatcaattgcgattgataccattttgaaccaaaaagatcaaaacatgatctgtgtgtacgttgcgattgggcaaaaggacagtacggttcgagctcaagttgaaacgttgaaaaaatatggtgcgatggattataccatcgtgctgactgctggcccatctgaacctgcaccaatgctgtatatcgcgccttatgccggtgcagcgatgggtgaagagttcatgtataacggcaagcacgtcttgatcgtgtatgatgatttgagcaaacaggcaacctcatatcgtgagctgtccttgctgctccgtcgtccgcctggtcgtgaagcctatcctggggatattttctatacccacagtcgcttgttggaacgtgctgctaaattgagtgataaactcggcggcggttctatgacggcgttgccggttattgaaactcaggcaggcgatatttccgcgtacatcccgactaacgttatttctatcacggatggtcagatcttcttacaaagcgatctgttctatgcgggtacacgtccagccattgatgctggtgcttctgtttcccgtgttggtggtgatgcgcaggtcaaggcgatgaagaaagttgccgggacattgcggttggatctggcatccttccgtgaactggaagccttcacgcaatttggttctgatttggatgcagcaacgcaagctaagttgaatcgtggtcgccgaacggttgaagtgctgaagcagcctgttcacaaaccgttaccggttgaaaagcaggttatcattctttacgcattaacccatggcttccttgatccaattccgattgaagacattactcgcttccaagatgaactgtttgatttcttcgatagcaatgcagctgatttgctcaagcagattcgtgacaccggtaatttaccggataccgataaacttgatgcacaaatcaaggcttttgccggcggattccaaacgagtaaacaacttgctgcagcgaaagactaaggaggtgccgcatggctgaatcattaatggacattaagcgcaagatcgcatcgaccaagaaaaccggtcagatcacgcaagccatgcagatggtttctggggccaagttaagtcagatcgaaaagcgggctaaaaagtatcagatttattctgataaggttcgccagattgtgacccatttggctgctgggcagcttcttgagttagccaacgctgcagaaagtgataccgattcgggcgacaagagtcaggtcatctccgttgctagcctgcttcagaagcggccggtgaagaaaaccggctatctcgtgatcacaagtgatcgcgggctggttggcagttacaacagcacggttttaaaagccatgatgcagatgatcaaagatgaccatgaaagtcctgacgattacgtcatgatggccatcggcggtgtcggtgctgattttttcaaagcgcgcggcctaaatctggcttatgaatatcgcggtgtttctgacattccgacttttaatgaagttcgggaaatcgtaaaaacagctgtgacgatgtttgacaatggtgtgtttgatgaactttacgtttgttacaaccatcacgtcaacactttgacctctgctttccgtgcagagaaaatgttgccgatcagtgatttggatgtcagtgaagtggccgataccaatgttgagtatctgattgaaccagatcttgactcggttttggaatcagttttgccgcaatatgcggaaagtctgattttcggcgcgattatggatgccaaaacggctgaacatgccgcttcgaccactgctatgcgtagcgcaactgataatgccaatgacctgatctcacatctgtcgacccaatataaccgggcccgacaagctgcgatcaccactgagatcactgagatcgtcggtggtgcggcagcactagaataatcacgcgctcgctggtgctggttcttaaacacaccagctcggtgctcatcataacgcgctcgctgacgcaggaacctgcgtgtaaggaccttggccgcaatgaccaaagtgcggtcatcccagccaaggccgcttacacttcggttcctaaacgcgtcagctcgcgctcaatttacaacaggaggacgaaaatgccaaattcaactggtaaaatcgcgcaagtgatcggtcctgttgtcgacgtagccttcccaatcaatggcgatctgccagaaatcaataacgccttgaccgttgccaagaaggatggctcccagcttgtgctggaagttgccttggaacttggtgatggcgtgatgcggactattgcgatggattccaccgatggtctgcaacgcaacatggcggttcaagatactggcggtccgatctcagtccctgtcggaaaagacacactgggtcgggtgttcaatgtgttgggcgaccccatcgatggcggtgaagcctttggaccggatcatcggcgcgacagcatccatcgtgatgcgccaaaattcgaagatttgaataccagttcagaaatcttggaaactggcatcaaagtcatcgatttgctcgaaccttacctgcgtggtgggaaggtcggactcttcggcggtgctggtgtcggcaaaaccgttttgattcaggaactgattcataatattgccgaggaacacggcggcatctccgttttcactggggtcggcgaacgaacccgtgaagggaacgacctttacttcgaaatgaaggaaagtggcgttctggagaatacagccatggtctttggtcagatgaacgagccgcctggtgcccggatgcgggttgccttgaccggattgacgatcgcggaatacttccgtgatgttgaaggtcaggatgtcctgctgtttatcgacaacattttccggttcactcaggccggttccgaagtttctgctttacttggccggattccatcagctgttggttatcagccaacgctggcaacagaaatgggtcagttgcaggaacggattacatcgactaaaaaaggttcagttacatcgattcaggcaatttatgtgcctgctgatgactacactgaccctgcgccggcaacgacttttgcgcatttggatgcaacgaccaacttggaacggcgtctgactgagcaagggatttatcctgccgttgatccgctggaatcatcttctagtgcattgacgccggaaattgtcggtgatgaacattataaagtcgctaccgaagtgcaacaagttttgcagcggtatcgtgagttacaagatatcatctctattttggggatggatgaattgtctgatgaagaaaaggtcgttgtggcccgtgctcgccggattcagttcttcttgtcacaaaactttaacgttgcggaacggttcactggccagccaggttcatatgtgccggttgaagaaacggttaaaggctttaaagctatcttggatggcaaatacgacgattaccctgaagatgccttccgttcggtcggtcgcatcgaagaagttgtcgaaaaggctaagaagatgggctttgctcctgacgatcagaatacggatgctgacgaaaagccggctgcacaagctgcagctaactaaggaggcgacgcgttttggctgaaacgagcaacgttcttcgggtcaacatcgtgacgcctgatgggttagtatacgatcatcacgccaggatgctagttgttcattctgtcgcaggcgaattgggtattatggctaatcacgaaccaatcgtgacaccacttgagatcggtgaggttgacgtgcaacgtgttgacgccagtgatcacaacgattcaattgccgttaacggcggttttatggaagtatcagaaaatgttgcttccatcgtcgccgattctgccgagcgtgagcgtgatattgatctcagtcgtgcgcaagctgcgcgcgatcgtgctcaaaagcgcattgctcaagcaaagaatgatcataatcaagacgatcttcggcgggcacaagtcgcactgcgacgggccatcaaccgaattaacgtcaagaccagtcattaaacatgaaaagcagttctctcccaacttggagaggactgctttttgcttgtttgctgcttgatgaaagctagcaaaacctgcaatcaagaccgcttattttccggtttctaaccgggctggttcacgctcttgctgaaacgcgttcacaggcgcagaaacctacacataagggccttgaacctaaatggccagagcccagccatttagattcaaggcccttatgctccggtttctaaccgcgcctgttcacgctctgcttgcgtcttatcgtgttctgcgggaagatacgtcatgaggtgatcatatgtttcagacaatcggtttaaacggcgcgattacaatcgtgtcacattttgttttcatcatgctcgcgttccgtgcactcaatgccttgcgctttgaacagttcatcaaagccaaccatgttcgtgaggcacaggtcttgttactcttcattgcggttgcgctaggattcttagtcagttcgttctttctatcactcttacaagcagctttaaacttacctaaacttttcctgtaaaaacctcgtcttaactatggtataatgcgatagttagtcaatttacgaggagagatatatacccatggcaaaagatattgggatcgacttagggacggccaatgtgctgatcaatgtaaaaggcaaaggcatcgtcttaaatgagccctccgttgtcgccattgatacccataccggcaaagtgttggcggtggggacagaagcctataaaatggttggacggacaccgggtaatattcggtcgatccggccgttaaaggatggcgtcatcgctgactttgacattaccgaagcaatgcttgaatattttatcaataaactaaatgtaaaaggtgttttttcaaagcctaatattctgatttgtgcaccaaccaatattacggatattgaacagaaagcgattattcaggcagctgaaaagtctggcggccgccatgtttacttggagttcgagccaaaagtagcggctgttggagcgggattggatattttccaaccacaaggcaatatggttattgatattggcggtgggacgagtgatattgctgtcttatccttaggcgaaatcgtcacgagtcgttcactgcgcttggcaggtgacaaaatggatgcctccattgctgcttacgtgaagaacaagcataagttaattattggtgagcataccgcggaacagatcaaaatcaagattggtgccgtttacgaagccgatgagaaagaaacgattgaagtccgtggccgtgatattgcgactggtttgccacgcgaagtttcggtgacatctgttgaagttgctgaagctttacatgagacgatgatggcgatcattgaaggcgcaaaaggtgtgcttgaaaagaccccaccggaattgtctgcggatatcattgatcgtgggattatgctgacaggcggcggcgccttgcttaaaggtatttcacaactttttgctgcagagttgaaagtgccagtgttgttggcggacgatcctttagatgcagttgcacttgggaccggtgttttactcgataatattgaacaccatcgccagtactaggagcgagctatggactcacaatatcctaaacgcatcttccacatcattaaaatttggctgatgatagccttaatcgcactgatattgggcttattgattggctttgctcttggggaaggtaatccgcttaagttgttcctaccatcaacatgggtgcacttctttaagtttctgcgttaggagtgtttcatgaaacaggttctgacatggttagtgcggggctaccagcgcttcatttccccgttgctgccgccgagctgccgatattatccgacatgctcaacctacatgattcaggcgttgcagaaacatggcgccatcaaaggttccttaatggggattgcccggattttacggtgcaacccctttgttaaaggcgggcttgatccagtgccagcttttttcactttgcggcgtaatccgcatcccgaaaatgacttggatcttagtgacattcaaaatctcaatcataagctaggaggccgtcatggctaaggaaagaaatatcaaggtcacacaggcagatgaaactcgaaatggtcatacagtttcggttttaaaaatcggtgaccgggagattggctttattgaaccggacggcacgcgattttcagcatttgtagccggctcgactaagcctaaccggttcaaaacactggatgccgcagttaatgcgttgattgccgaataccatttacatcaaggctgaaacaactctggcaacgcgcatcgcaacatccagtgctccgtgattttagaggtaaatcggtatttaaacggttttatcatcaacgtttagctagtaaagaatatgcttttgcgaaaatcgaaggcattttaagaacgaaacgtgaaccaacgcgtttaggcaagaacgtgaactggcacgttcagaaaccgggacataggcgaccttgagacgacctgttgggttttgaccctttagtttcaaggctgttatgtgcacgtttctgcgtcagtgaacgtgtttaaaggagggcagcccgtggagtcacacgaaatcaaatcaaactcagagggtgatcggattgattatggcatcatcctgtcagtcatgttactggctttgatcgggcttgtgtccatctatctggccaccgctcatgatacttctacgctacagaatcctgttcgtgccacggttatgcaggcggcgtggtatgtgattggcggtatcggcattttcttcgttatgcgatttgatgcggagcagctttggcgcattgccccttatttatacgggattggcatttttctgatgattgcggtattgattttttatgaccgcaacacagaagccagtacaggtgcgaaaagctggtttgcccttggcccgatcagttttcagccgtcagaagtgatgaaacctgcctatattttgatgttgagtcgcgttgtgacccaacacaatgctgctttttcacataccattcaacacgattggcagttaattggccggatggttttgtggacattaccgatagcagtcctcatgaaatttcaaaatgactttgggacgacacttgtttttctggcgattttcgctggtgtcaccttggttgccgggattaattggcgcattctcgtgccgattgcacttgtggctggcattatcgggacagttggcattctgttagtgacgcagacatggggtcgatctattcttggtagtatcggctttaaaacatatcaatttgcccgaattgattcgtggttaaacccttctggtagtacaactggcgacagttaccagctgtggcaatcaatgaaggctatcggttctggtcaattgactgggaaagggccgatgcacattgcagtgcctgttccagtccgagaatcggatatgatcttttccgtgattggcgaggctttcggttttgtaggtgctgcggttttgattctgttatactttatgttgatctaccaaatgattagggtcacgtttgacacaaaaaatgagttttatgcttacatctcgactggtgtcatcatgatgatcctattccatgtatttgaaaacatcggcatgaacatcgggttactaccattgacggggattccgctaccatttatttcacaaggtggttcattcttgttggctaatatgttatcagtcgggatggtcttgtcgatgcgctaccatcatacgagctacatgttcagtcgcgacacagaagattttgaataggggagagcaaaatggcaacaacttatttttggcaagatgaactggctgccgggcaaattcgtctcggcttgacccaagaggctcaagaaacgttaggcaaaatcaagtatgttgatttgccaacaattggcgcgagccttaccaccggcaaaccttttttaagtgttgaagccgaaaaagccgtgttagatcttgaggcaccgttagcaggaacaattgtggacgtgcatcaggaattgagtgataaaccagctttgttagacgaaaccgatcataaccaaaactgggttgtgacagtttcaaccaaatagctaatcaaaaagccgacccgcatttttaaaatgacggtcggctttttgcatggcacattgtgagttagcgcggcttattcgaagaagcgcttggcaatttcttgataaattttgatcgccgtcgtgtaactgttcaggtcgatgtgttcattcacttgatgactgaagtggttatcaccggggccatagacaatcacatcaaaatggttagttgatttgatgaactcggaagcatcggttcctccaaacgcaacggctaattcagctggtttaccagttaccgccgcgatggcagcatttgccgaagttaccaagtggcctgttttatcggagtgaaccggcagaaaacggtgcaatactttcaacgtgagtttcgcattggtcgtggcgttgacatgtgccactaagtcttcaagcattttcacaaccagctcaatattggccgatggggtcgggcgaagattgccacgaaggaaagcgtgggctggaatggtgttgacttggtcgccgccattgatgaccgtgattgaatgtcgaaatgggccgagatccgggtcagcaggcgccttatcaaaggcgtgatgttccagtgcggcaaaagtcgttagaccatcgatggcattgacgcctttttcaggcctagaactatggacagagacgccttcactgtcaatctcgtaattcacggtgccagcatgtgcatattttaagattttagtggtgggttcaccaacaactaagccagcgagatcatcggcatagccttgctctgtcagcaaacgagcgcccatcgcaccgtattcttcgcctaccgttgcaatcaagcgaatcggatgagtgaacccggattgtttgagggcgatcagggccagcaccatggcggctaaaccgcttttcatatcatcggtgccacgaccatacatgacattgtcgacgacttttccggaaaaaggtgggtacgtccaggctgactcgtctccaggactcacaacatcttcgtggccagtgaaaccgagaacgcgatcaccatggtttaattcggcaattaaattcacgcggtcttctgtgtaggggatcagcttggtaggaatatcggcagcctcaagttcggcttgcagcaatttggcgacggcgagctcgttgccatttacagaattgatttgaatcagcttttggagcagggcaattggttctgtcatgattgcaccatcctttgtcgcgacagtcagctattgcagactttgtgcgcgagttttgttgagcacagcttacactctttttgatttaaaattcaatgattgacaagttaaaaaattgtgataagctcacttgtacaaacttgaaattgattgtaaacgaactgagtgagtagttaccgcgaggcagtacagaaaacctgatgagctgagagcagggtcgctagcggaaatgaagatggcttggcacacacggcacaccgagcaaattgcgaggctgtgatggttggcacccattatcctgcacccggatgaattcgtccgctgagtggatcacgttttgtgtggtcaattagaatggtaccgtgggccagagctcacttctaacaaggattgataatttgttagaagtgagttttttttcggtctttttgtatcaatggcaagtttatgcgcctcggactgcaggccgacgcacatattttagagagcgcgagtcagctcggtaagaaaccgaagcataaataggcggggacgtgatagccgtattttggccactaggaaacttatgcgtagattgatgggttggcgaacgtatttaggaggagaagacatgaaacggttttggaaaattttgacaaccatttttgttttaggattagtcttggttgggtgcggtaaaagtagcagcagttcgtccagtagtcaaaagcaaacgacggtgaaaatcggggtcgttggcgcggataatcgcgtcttgcaagcagttgctaaaaaggttaaaaaagagggcattacgatcaagatcgtacagttctcggattacaatcagcctaacaccgccttgcgcgatcatgatattgatttgaacctgtttcagcatcagtatttcctgaataactggaacaaaacccacaaggctgatctagtcagcatcgggcagaccatcattgcaccactagcgatctattccaaaaaaatcactaaaattagccagatcaagaaaggtgacaccatcgcacttcctaacgatccgactaacgaaggccgcgcattacagttacttgaaactgctggtttaatcaaactgaacaaaaaggttgccttgccaaccacgcgagacgtgaccgaaaacaaattggatcttcagttgaaggccgttgatgctgcccagacagcaagttccttacctgacgtggctgcttccgtcgtcaactctggccttgcacacgatgccaaactggatcccaagaaggctgtttatactgaaaaagtcgacaagcaaagccaaccatggattaacgttttcgtcgcaaacaagaaagataaaaataatgctacttacaagaagatcgtcaaagcataccgaacaaaagacatcgctgacttgattgagaaactttatcatggcagtgaagtcccagcttggacgcagaaattttaatggtgagttgagaaagttggtatataagtaagcaatgttgagggtaatccgagttgaattctaggatagaaagcagagagttggcggagcggagagggggctcagccgtgaaattgttgttggcggtttaccgcttacagcaaggccagactttgaaatcgcgcgggctttgcgtgagttcaaagctgtgcccacagctctagcttcgcggtcgccagccctcctcgccgcgtagccagctcggactacgggagatgctttactggaataaaactgaagaaaaagtatcagtcgcattgcgaaaacgcgttcgcagccgcagaaacctgcacataaggacctcaagcctaaatggccaaggcccagccatttaggcttgaggccacttatgctccggtttctgaacgcggctgctcacgctctgatttaaacgcgttcaccagcccagaaacctgcgtataaggaccacaagtgcaatggccaaagccccggccatcacacttgaggccacttatactccggtttctaaccgggctggttcacgctctgagtactttatcttgacattttacctaatcatcgtctaaaatcgatttaattcatttcgggaaacgaatgacgtgagtgagtagatctaatcagactgtacagaaaacctgggtagctgagagcagggtagttaattggatcgaagatggctcattgatcggcatcgctgagcagtggttaagcgatgatggctggcggcctttaatccgcacacaggtgattgcctgttattgaggacgcgatggcgtcgaattagaatggtaccgcgagctaggctcgcttctaaaacttgtttttagaggcgagcctttttgaatgctttcatcgcttgcacacatcatttgtttacctgaacgaggaggagaaagttcatgaaattttggaaaaaggcaattttgacgtttgcactgattttaccagtatttgttttagcagcttgtggcaagtcggctagttcaacgaagaataccacggttaaagttggcatcatgagcacggataaagaaatttggactgatattcaatcacgtttgaagaagcagggtgtgacgatcaaacttgttcagttcactgactataatcagcctaatcaagcactggaagatggcgatattcaactcaacgccttccagcatcacaatttcttggataactggaacaagaaacacaacaccaagattgttgatatcggcgcaacctacatcggtccgatgcgcgcgtactccaacaagatcaagtcgttgaaggacgttaagaacggcgatcagatctcggtaccaaacgatccttccaacgaaggccgtgctttacagttgttggcacaaaatggtttgctgacgttgaaaaagggtgtagcttcaccgactattcgcgatatcactgaaaataagctgaatctgaagtttactgaattggatgccgctcaaacagcccgttctttgaatgatgtcgcagttgctgttgtcaacaatgatattgctgctgccgctaatctgaagccagctaacgcaatcgcagttgaaaagattactaaggcgtccaagccttgggtgaacttcattgctgccaagtcagccaaggacaaggacaatgcgacctataagaagatcgtgaaagcctatcagacacagcggacagctgatcttttgaagaaagtttacaaaggttcaaccttgccggcttggaactataagttttagttagaaacggggacaatcatgtcagatcaagcagttgtgactttaaaagatgtggacgttgagttccacggcaaaacccgctcggtgcatgccgttgatcatgtggacttaacggtcaaccgcggtgatatttatggcattgtcggatactctggtgccggcaaatccacacttgttcggaccatcaacttgctgcagcgcccaactggcggcagcgtcaacgtcctaggccaggatatgttggccttgtcgccggcgcagctgcgcaaggaacgcaaacgtatcggcatgatttttcagcattttaatctgatgaacagtcgaactattgctgacaatgttgcttttccattaaaaggaatcaaatcgaagcaagcgatccaaaagaaagttgcggagttgctcgatctggttggactcactgaccgcgctaattcctatcctgcgcaattatcaggtggacaaaagcaacgcgtcgggattgcccgcgcgctggcgtcagatcctgaaattctcatttcggatgaagcaacgagtgcacttgatccaaagacgaccagttctattctggagttgctccagtcgctgaatcaacgactgggcctgaccattgtactgattacccaccagatggaagctgtgaagcagatctgtaatcgtgtggcggtcatggatgatggggcaatcattgaacgcggtgacttgttgcaggtcttttccaatcctcagcaacagttaaccaaagacttcattgatactactttgcaactggatcaggcgattgatgctgtcatgcagcagccgaccgtgaaaaatctggggccggatgatcgtcttttacgattaacctacgtcggtgattcagccgatcaaccgctggtggctaagctgtttagtagctatcatgtcacggcgaacattctgtttggtgacattcagattttacaggatacgccgtttggcaacttaattgtggttctttccggtgaccatgatgaagttgaagccggaatcgcgtatttgaaacagcaggatgtcaagattgaagacattcttaagaaggaggcctagacagatgggacagttctttacaaaatattttcctaacgtggtccctatctggtcaggtgacggcggggtgactcaggcaatcaacgaaacgttgtatatgaccgtgttgacagcagttgttgccggcattctcgggattgttattgggattctgctggttctaaccgatgaagatggtttactaaccaaccaaccattttattttatcctcgataaactggttaacatttttcgggcggtgccattcatcatcttgctggcaatcatgacccctgtgacgcgagccattgtcgggacggggatcggaccaactgcagccttggttcctttaattgcagggaccacaccgttttatgcacggcaggttcaaaatgccttattgacagttgatcctggcgtcatcgaggcagctgaagcaatgggtgtttcgccgcttggcattgtgttgcgggtttacctgcgcgaaggtttgtcagaactcatccgagtttcagtcctgacgatcatctctgtcatcggcttaaccgctatggcaggtgcagttgggggcggcggccttggaaatctggcgatcgcggtcggttaccaacgttaccaatacgacgtcatcatcgtttccttaatctttattctggcgatcgttttcttggtacaatttatcggtgacttcttcgcacgaaaaacccatcattaaatttaaaactcgttttgtaagcagaactcgtgatagcgttctgcttttttttgaacgcgtttgccgctgttctttttatgacgtagaatggcgatataactaaaagtcaaattccagtcgggggtatcatagtgcacacacttgagattaaggatttacatgtcaaaattaaagcagaacctgagcatccggagattttgaccggcgttaatttaaagttagcgactggtgagattcatgccattatgggtccgaacgggacaggaaaatcaacattagccgagacgatcatgggcaatcctgcttatgaagtgactcaaggcgatgtcttaattgatggtcagtctattttagacatggcagttgatgaacgcgcgcgagccgggctttttctagggatgcagtacccgcaagaaattgctggtgttaccaatgccgagtttattcgggcggcgatcaatgcacgccggccagaagatgatcagattcgcatcaccgactttttaaaacaattggacgacacaatggcgaccctcgaaatgccggaatccatggcggatcgttatttgaaccaaggcttttccggtggtgaaaagaaacgcaatgaaattctacagttgatgatgattcacccgcactttggtttgttggatgaaattgattccggcttggatattgatgcactgcggattgttgccaagggggtcaacttattgcgtggaccagattttggcagcatgattattacgcattatcaacggctattggattacatcattcccgatgttgtgcatgtgatgaaaggtggccgaattattgaaagtggcggcccagaacttgctaaagaattggagaagactggctacgaacaccttaaagtaggtgatcaaaatggctgaagcagtgactttaccggcacctaacttgcccaagtttcctttagctcggtatttaaaacttcagcctgatgccgtccgagatcgtgtgattctacacgcaccgcaatcggttgcctatgcagcaggctccagtgaggttcaacggttcaccccagtcacgtcattggatgcttggttacttgcacacccccaaggcgcgaccacgattgatattccggcccattttgtaagcggtgatgagccgattgtcttgactggtcctaagcaagcgggtggactgctttatgttcatgtcggcaaaggcgctaaagtgacgattcaggaaaaatgggcgagcggcggcaatgttttaggcgtttggcttgtgttggttattgatgccgatgccgaagtcagctggctgagttatgacagttttacagctgagaccgtgattgcaaaccgtaccgccacgcttggtgccaatgctaaattgaattggaccttggcagggttttcgcgaaactccggccttaaccgggtggatgtccgtttattgggccaaaatgccgaggcaaccgtcaacgtgggtgtgcttgcggcaggaagtcaacatgtcagttacacgacctcggtaaccaatgaagcgcaacacacagtagggcatattaaccaacgtggcgtcattactggcagtgcccatttattattcaatgggattggtcacattatcaaaggtgcacgtggcagtgatgcccaacaagaaaatcgggtcttgatgttgtcgccgcacgcggaaggtgatgccaatccgattctgttaattgacgaaaatgacgtcaccgcaggacatgcggcttcagtgacgcgtgtgaatgctgatcagctttactatctcatgagccgtggtttatctgcgacattagcgaaacggttggtcattcgcggtttccttgaaggcggcttggctgaaattgatgatgtccgactgaagaaagaactcttcgcaacgattgatcgaacgctggtggctgaagatgcgtgaacaatttccattttttaaagctcatcccgaactggtctatctagatacggcggcgacttctcagaaaccgcaagctttactagatgctattcaaaattactatgtcaatgataatgccaatgttcatcgtggcttgtataaattggcttatgacaccaccgaggcttatgaaaacgtacgccaacaagtggccggctttttaggtgcggcgagtgctgacgagattatttttactcgcgggaccactgatagcttgaacttggttgctagtgcttatgggccgcaagtcgtcacggctgggtcacaaattgttgtgacaggtgcagagcatcacagtaatttcattccttggcagcaattagccaaacgccagcaggctacgttcacagtgacgccggtaaagccggatggcacggtggatattgctgccttattagcggccatcacgcctcagacgaaggtggttgcggtggcgcaagtgacgaatgttgcaggtgatacgttaccgattgccaaaattgcggccaaagcccatgcagttggtgctgttgttgttgttgatggcgcgcaggcggtagcacatctggccgttgatgttcaagctatgggggcggatttctatgcattttctgggcataaaatttatggcccaactggcattggcgtcctctatggccgcgctgatttattgcagcacatgccgccgattcagtttggcggtgaaatgatttcagaagtccgcgatgatgtcagtacttgggcagacggcccaattaagtatgaggctggcacgccgcacattgctggcgtgatcggattaggcgctgctttaacgtggtttgatcagtctgtgaatgcagcagcatttgacaacgaacatcaattggcagatcagttacgcgctggcttggcagcgattccagatgtgactgtgtatggtaatcaagcaagtttggcgactgtgtcgtttaacttaactgggattcacccgcatgatcttgcgactttcttagatgagcagcaaattgcggttcgtgcggggcatcattgtgcacaaccgctgatggcgcgactaggggtgccagccacggttcgtgctagtttcggcgtttacaacaatgctgacgatgttgaacgattgattcaggcagttcaggcggcaaggaggtatttccatggcattgactaagctggaccagatgtatcgggcggtcattttggatgaagcacaacacccgcgacatcacggggttttgccagcttttgaccatgaaattacggttcgcaatccaagttgcggtgatgtcttgcatcttcaaatcaaagaggatgccggccgggtaacggacgtggccttctctggtagtggctgtacgatttctcaagcaagtgctagcctgatgacggaacagatcattggcaaaacgccagcagacattgaacaaatggtcgaaacgttttctgatttgatcattaacggggatgtgccaaacgctgatattttaggcgatgcagcggttttaaagggcgtccaccaatttcctgcacggatcaaatgtgccactttggcatggaaagcagcggcgcaagttttgacgcagaaaggtgaagaccatgactgagacaaaaaacactaaaaacaatgaaactgtcgcggcagatatcgactttttgccagaagacaatccagcagattttaaggatgatatcaagccggtgtattctacaggtcggggcttaaccgaggaaacggttcgcgctatttctgcggagaagcatgagcctgactggatgctcgattatcggctgcgtgcttatgcaacgtacaaaaggctggcaatgccgaattttggcccggatctttccgatcttgacttggacaacatgctttattttcaaaaggcgacggatcgaacctatcgcgactgggatgacgtgcctgacgccattaaaaatacgtttgatcggttaggcgttccgcaggctgaacgtaaatatttggccggcgccagcgctcaatacgagtctgaagtggtttaccataacatgcgggatgaattcgaaaaactcggcattattttcatggacatggactcagccttgaaagagtatccggaactcgtgcatgattattttggcaagctggttaaacctagcgacaataaatttgctgctttgaacggtgctgtgtggtctggcggcagttttatctatgtgcctaaaggcgtgcagacagatgtgccaattcaaagttacttccgaattaatgccgagaacactggtcaattcgagcggacgctgatcatcgttgagcctggcgcgcatgttaactacgtggaaggatgtacggctcctaactattccagcgacagtttgcacgcggcggttgttgaagttttcgtcaaaaatgacgcttactgccgctatacgacgattcagaactggagcaagaatgtcttctcacttgaaaccaaacgcgcacaggcactcgacaacgccactatggagtgggttgacggcaaccttggcagtaaaactacgatgaagtatcctagcgtgtatcttgacggtaaaggcgcgcacggtacgatgttaagtatcgcggtcgcaggtgaaggcgttgatcaggataatggggcacgaatgattcataatgcgccaaataccagcagttcgattgtctccaagtcgattgccaaagatggcggcgcggttgattatcgcggcacagttcgcttcactaaaaaggcagacaatgccttttgccacgtagaatgtgacacgatcttgatggatgaaaaaagttcaagtgatacaattccttataatgaaatccataatgccacagtgtcaatggaacatgaagcgaaggtatcaaaggtttccgaagaacagttgtactacttgatgagccgcggtatttctgaagccaaggccactgaaatgattatcatgggctttgttgagccatttactaaagaactgccgatggaatatgcggttgaattgaatcgtttgattggtatggaaatggatgggtctgtaggctgaaatcgagttcttattttaatgtcgatttttgaagaaaagctggctaaattgttatctgcaatctggaggttgtggatagacgtttagccagctttttttattcgacataaaaatattaggcaagcctaactttttactttatgatagaagcggcaacaaaaacacactaatttaggaggccgcaaatggataactatgataaagcaagaaaggttttgcaatcaacggcattgtcaaaaatagctcagcagaccggtatcagtatcgggcagatttggcattatcgtgatcgtcacgaaggcattgaaaaggcaccagaggcctatgtaaagaagattgccagtttgtatcgaaataagcggtattgaaatcgctagaataaggggcttgttaatttggccaaattgcaagaagcgtcaggataaaagctatgaacccacaaaacaagtcgtgagcctgatagcgatcacacgtcatgggtgctacaattaaattactgatttgcaaactgaatctcaattttttgcatgctattgcgtgtgccatgatcgcgaggaggtgtaccatggctgaggatcttgaacattttatcaagacaatggcgctggggattccaacgattaaaccagacgaaaagcgagcttttctcggtaattttcgtgagcgagttgcgatggccattacgattaagcagttacgcgatgcacgaatcaccaccatgcttgatgcggtgttgacccgttatcctggttatcgaatttttcttaatggccgaatgggcgaaagtctggtcaatcaatacatgatgcaggccctagcccacaactatcctttcaccattatgaatcaaccgggaatgcgcgtgactaagcgcgttttgcaaaccgattttggctgggtattggcgcacccgactcagaaaatagcccgacccatccttttataagttggcgacgcacgccggttgtgaagccgtttgccagttgaacattgcaaaaagtgcggttagtttctgacgacaatcacgtatttacaggaggtccattttgacgcaacttgatacgattcagcgaacggtacaacaactacgcgatttgctgaataaaggcgaaatttttacagcattaccgaatatgttgggcaaagtgattgaaagcgtggcagttgaacctgctaccccgattaaaatacctagagacgacaagacggccattgtcaaaatcagagctatccagaagaggatcaagcaaacaagtgatcccagcgtgactgatgatgagattgactttttggtagcacatttggcaagtaccaaccctgcagttcgggataaaggcgttttcttcctgttcaatgatttgtttcaggcggaggccttcaccaatgagcaaattaaaacgcttttcaagcggctgcaagcaccggatattttgttcaatcatatttttgaaccgcaaaacaatggtatctttttgcgcagtttttcgttgatgattctaagcggcatgatctatgctgatcagaatcgttaccacgtgttgactaaagccgattatttggcgactgttcagaatatcgccgtttatattctgttagaaaaagatggccgtggttatgttgagaaaaagggctgggcacatgcctatacacatattggcaacatgctggaagaattgagtcaagttggggtcttaccgcgagctgagaaagttttgctcatggccgcagttgtggaagcttggcggcgcgtcgaaacaccgcttgtttttggggaagatcatcgcatggctttgtatctgagcagcctgaccaacgtcaataagttttacagtgaaaccttattgatgtgtctcaagaattggcagcacgccttggtgaatgttcgtccgcaagaatcctacagtttttgggttcggtggtacaaccgcaatcgattgttgcaagcattggccctgcgagctgatttgccacagccgattgccgattatattcagcaaattgtggatcttttttagtccagatggtcaatagaagggagcacggctttgattaaggctattatttttgatatggatggcgtgattgtcgactcagagccgtgtgccttagaaaatcgactggcctatttacgtcaggtggggattgaagccgatgatcgcaagttggctgggttattagggcgcaatatggccgatgtttggcgcatcattgcgccttcgaaagatgctctgcaacttcaagcaggttatgtggcctacaaacaggcccatccgattccgtatgcaaagattgtaatgccgggtgcacggccaactttacaatggttgaagcagcatgatatcaaaaccgccattgcatcagcctcagatctgaccttcatcgaaaagatgtgtacagagacaggcttgcgtcagtattttgatcaattgcttagcggcgccgacttcacacgcactaaaccggcacctgatgtctacttggcagcgctgcaggtgctggacgtggctgctgaggaagcgatcgcggtggaagattcaacgcttggtattgccgccgcaaaagctgctggtctatatactttagcagtcccgctacgtgatccccggttcactcaaaatcagcaagcagcagatcaacggattaagaaactaaccgatattatgggaatagttgatgataaaaattcttataatcaataagcatttttattttgcgtttatattataaaatttatatctcgtggcttttagatacaaaagatcaaaatctaaaaagatattttttaaaaattgaataaatatcagttgttattattagcttttaaaaccacttatccgtataattgactctaggttaagggttaagccttgccaaaattctatgttgatgcacttaactgaaacactggggagtgataagtatgcgaaaggagcagcaaacactgcggatcttgggggataaggtccgttattatcgcaagttgaagggtctatcgcaggccgagctggcggcaaatatttgcacgcaagctacaattagcttgattgagaagcgtaataaagtgccaagcatgaatattttgatgcgattaattggtcgtttaggaattcagctggatgacattgttgtcgagcatcatgatcgggttcagcaactgttgaccggtattgattttcagattcagcaccaccaatatgcacttgctgcggagaatttgagtaagattcggttggataagatcaagaatgatgatgaccaaaagcgctactattattatcaaggaattatcgaactattcaaaaacaatgcaccggatgaggcgatttatttctttggccgagtcctgagcccgttagttaactccgaacgtgacctttttggtattctagcaacgctggggttaggattggcctatgctgccaagcatacgtttgaccgatctcgagtctatattgatcaagcgttacgcatgttgaaacacgtgccactgtctgacagtaaatatctggatgttgagttgacaatttattggcacattgcccgaatttattatgaactcagtgactttaaggccgtcctcaaatacactgatctgggtgttcgagaggcagtcaagcacgataaacttttccttctagatgaattgtttgcattacaagcaagggcgctcaagcttttgggtgaccccgatgcctctaaaagttatcaaattgcgatcgcatttgcccgagtgacaggctcaacgcctttggaaacgagcttagtcgcagaaatggtctcgcaaaaaccaaatattgagacagcttgaaaaatcctcatagatgctgccgtctatgacgaaaaaaatacctgaaaacatcggctgatttaagagccagatgtctcaggtatttttttattttttaagcaggttttaatgacctatcttacttgaatattaaaattataatgattatttatcactgttgtcagttggctttttagtgcttgccagtgccggtttgttggccaaatcggtccggacaaccaagacatcgcaaagtgcgtttcgtgtcacatattcagtgacggacccaatcagtaagcgttcaacagcgttcaaaccggtggcgccgatcataataaggtcgatattcttagcctttgggatatcacgggcgatgatcgtcttcggagcgccatactcaatactgaaactgaccttgtccaatcctgccttcttggcttgatccacatagccttccatggtactcttcgcgttttctgtgacttgttcaaccatcgctgagtcaaaactggaaacgttctggaacgcgcgggtgtcgacaatatgaatgagaatcaattctgcgtcattccgttttgcaacggcaaccgctttcttgaatgccaactcagcttcgtatgagccatcgatcgcaaccaaaatatgttgatattgttgtaacattcctcatcacctctaccttcattgtacttgatttaatcatggaattaaatgaaaagcgtttcacaacttcatttgggtcagactaattagcacgaaaatcatggctaagaaggcaccaacgaccaaaatcacgagatttgcccagagcggaaagaaaagaccaccaatgatagcagcaatgccaacaaggacaaacaggcaagcaaatagtttaagaaaacgggttaatcccggtgttggtttcttaataatcaaaaagttttgttcacgatgcgaccatgtataggctgctaaggcaaacgttactacggcgtaaatgcccattaacaagagagtcacgagagtcctcctatctgttttctttattatgccatagctggcagggaatggcggggggatttttctgaaaattgagtgacttttagacgctcgtgttcccacttaacattaacgggttcggtctacctgtaagggccttggacgcgctggccaaagagcagccatcacgcccagggccacttacattccgactcctaggcgctcctgctcacgcttcgctataacgcgttcgccagcccagaaacctgcacataaggacgtcagccataaatggcaaaacccagccatttatggctgaggccacttatgctccggtttctaaccgggctagctcacgcttgaggctatttttttgcggaaggctataactgacactgggctagctttctataacgcgttcgcagtcgcagaagtctacatgtaaggaccttggacgcgctggcgaaagagcagccatcacgcccaaggccatttatgctccggtttctaaccgggctggctcacgcttccacaaaaaaagccggcactgggccggccaaaaacaggtttggtttttgtgaaaggctaattggtgccgttttcttcccggatcgttgaaacccgctactagctatgtgggcccagacgccagagacattagccgctaagtgaaatagcagcaccgtccaagactcttccggtcccaaggtctcgatactgttcggtcaactgatagttaaggaagcgcgaacaccttagaactttcatagttatagtagcacgggaaggcaagtagttgcaagcgtaaacgcttacgttaccttttcttagacttttgcgcatcacgctgccagtctttaagttgttgtagtcgctgagccagtgccgcttcgtatctgccggtggccttaggctgatagtagtgtttatttttaaggttgtcaggcagatattgctgtgcaacccagccgttgggatagttatgcggcagtttgtagtcgataccatggcctagttgtttggcaccgcgataatgggcatcgcgtaaatcatctgggatttggccggcattgccgttttcaacatcggcgagagcttcgtcaatagccttgataccggagttgcttttaggtgcgaggcaaagatcaatgacagcatcagccagtggaatgcgaccttccggcaatccgagacgttcagcactttgaatggcggtcaaggtgcgactagcagtggctggattggcaaggccaatgtcttcataggcaatgaccagcagtcggcgggtgatgctgttgaggtcaccaatggcgattagccgagcgaggtaatgtaaagctgcatcagcatcggagccgcgaatggatttttgaaaggccgaaataatgtcgtaatgcgcgtcgccgtttgtatcgccagccaaagcgggcttttgcagactttgctgaatggtagttagatcaattgtgatcgtgccgtcatcgcttgctggggttgataataccgctaattcaagcccgttcaacgctgatcgtaaatcgccattggttgcatgggtgagataatcaagtgcgtcaggctgtaagtcaacctgatagtcaccaagtccgcgtttgtgatcagctaaagcccggttgatggcgcttgcaatatcatctggcgtcagtggcttaacctgaaagatttgagttcggctgcgaatggctggctgaatgttcatataagggttttcggtggttgccccaattaaaacgatgcggccactttccaacaatggcagtaaaaagtcttgcttggttttatccagccgatgaatttcgtctagcagcaagatgacggtcccgctcattttggcctcttcagccacgatttgaagatcctttttagtgtcggtagcggcatttaaaatacggaaggcatacttggtgctgccagcaatggcactggcaatactggttttaccggtaccgggcgggccatagaggatcatcgagcttaatcgatgggcgctgaccatgcgacgaatgatgcgatctgggccaacaaggtcttgttgaccgacaacttcatctaaattttgtggacgcatgcggtaggcaagcggttgttgcaaggcgaaccctccttgtgtgtgtggcagtttaaaaatagacgttaactataggaagtacttttaagatgattgacttagtttagcatagagatgtgacttgaaaataggcggttgttgttgcacggggatgcttacgctccggtttctgatcgcgccggctcgcgctcttgttgtctgcgtgttaatctaattctagatcatcaaataaaggaatgacacatgttgaatcattattggcaactgatccagaaaaataacttgtttggcttacgggacgacactcggattggggtgattcggacggtgaagccggtgttggcggaaggcgagcagctgccagtgtgggcgaatgcgagtcggcatgcgttggtgcagcaggtgtcggctacaatgttacagttgacgacaccgcttttagacgatcccagcgaagttgtggcgtatttgcgtgcgggactcagccgcgtctgggcagcgctgccagaaaacggcaagctgccggttttcaccgccggattggaaaataatcagcgcattcgcattgttttgccggaagtgttgtttgagcggctttatacggcggaaaattttcaagggaatggccctgattatgtgacgtaccggaatcaaatttatgatttggtcgctgatgggttgatcacacaattgccgttactgacttatctctttgccgcttcaccggccaaaaacggccgggcattttggcctgcgccggatcaagaacgacaactggttcaaaaggtcagtgaccctgatcacttagcgcgaacattggctttggatgttgcagtggaacttgatccttatgcggcgagcggtgttacggaacaaatgttgaactttttaatcgacagttgctggtttgctttgagtcaaccagcgattccattgcccgcggcggctgaggtgcgtcggcatagtttggcagaagcacagaagattgctgctggcgatcccacggcaccagtcgcgagtttgacagcaccgattgatgccatggcggtctggctgaatcaggtcggcctcacaccgcaacgcaaacaagcttttgagttgatgcaaagccgagtcctgaagccagaaacgacgattgcgggtcaggtggcggcggcttatcatgatatttcagcagctcaaacaccgttagcaacgcaagcccacgcagatttgtcaatggaagaagatttaccgggcttcagtaacttgtcaggcaacagtcaagccttgcttcaggcagtgattgatggcgggtatcagtggaccttgctggatcgggaacagaacattctgcagattgccagtgatactcagcgccatgtgttgattgacggtgcgttgactagccgcacacctgctagtgccatggtggtagcagaacatcgccatgctgccaaaaaggtgttagcggcggctgggttacctgttgccagaggcgccaagttcacacgttggcctgaagctaaagctgcttttgagcaaagctttgcccgtaaaagtatcgtcgtgaaacctgaacagcgtagtcatgggcttgctgttgagcaatttgcggtgccgccaactgccaaacaattcgcccaagcctttcacgctgctaaccaagatcacggcgtattggtcgagatgatggggcggggaacaacgtatcattttactgttataggtcgccgtgtggtaagtgtgttggaaaatgccgctgccaatgtggttggcgatggtcgtaaatcaatcaaagaattgattgcgttgaaaaatggtaagcggccgaatgcacggcagctcaaacttgacgaaacagcaaatcggcagttgaagttacaatcggttacgatgaatactgtcttgcggcgcggtcagcagattttccttgcgtctgcggcgcatccgcaaacaggtggcgatatttatgatgttacaaccgaaatcgatccaagctacaaccaacttgcggttgccgctgctgatgcgcttgaattgccgattgccgccgttgatatcgtgattgataatctttatgacgcctatgctgctgagcatgaaggccaagctatcatcatcagtgtcgatccgattcccgacttaatgttgccacaacaaccagatatgggcgcggcgcattcaattgcacctgctttactcacgtatctgtttagcgaaaaataaaacatctgccgtcatgttcggcagatgttggttataactttttaaaaaaatcaaagccacgttttttcggcttttcagaatcttgctcaagtggtggcagatcaacattcgattgattaatcgccgtgtcggcaacaatcagcaatccagcggccttttcggctgtttgcgcggtttcattagccaccagcgtgaatggcacattcgcatccgtgagcattttcatataggggcctgtgatggcattatcgagcttcccgtttagcaacgctttataaccatgagcgtgaaagtctttgagtaaaggttgcacttgcgcttgtcgtttagggtcggccaatgcttgattggtgacctgtagagcaacacgttctcgcaaagagcccatataggctcgacgttcatcgggtttggtctgcgggggaccgtaaatcgcactgttcagatgttcctgcatattatcgtctgacattaatggtgcctccttttaaacgcattcatatgccctcattgtaacatgttcttatcttggaaaagaggttgtggttctgtttacacttgaagatttcgccgtttttaaggcgacaacgctggcgacacgaatgcatctgattcgcgaacaattggatcccaagtttgctgaggccgccacggtgattgtgccgctgctgcaaacagatcagcaggcgatctattcgcacattgcgaagcatcaacgtcgctatcgcaatccgccgccgaatacatgggtcgcgttttcaaccagttcacgcggttacaaaatggtgccgcatctggcgctgggcttttgggatgatcggctcttcttgtggctgtcagttttacgtgaaagtaagccggcgtcgcgggtattgacggggatcaccgcgatggcaacaaccttaccgggaaaatggcaagtggcaggggagcatacagataaggcgatgttaccactgacttcagccaatttagcgacagttggggctcgatttcagacgattaaaaaggcggagttccttctaggaaaagtttatttggcagatgatccgatttgggcagatcccgtgcggctttggcaggacatacaacagcgggttgtcgcccttaaaccaatgtttgatcagttggttcaaaacgtctaatgtcggggtgatcgcctgcaaatggatcattttgaatgctttgtatgagaatgccgcgagaattcagcgaaacctgtccgccgccatgtttagggtggtagaatcacactgtggtgttgctcgcctgcgcgtgttggtaaagttttggcgaacgcctattttgcctagttcaccacttggattagctagcaaactgcatcatgttaaaggagaaaagccatgccagatgtacgatttcatagtgtgtttgatattatcggtccagtgatggtcggcccaagtagttcccatacagcaggtgccgcccgaattggaaaagtggttcgcgatatttttggtgaagcaccagaaacgatcacgatttacttgtatgaatcgtttgccaagacttaccgaggccacgggacagatgtggctttggtcgcaggattattaggcatggcgccggatgatccgcatctacctgaatcaatgaagcttgcctatgatcaaggcattaaggttagctttgtaccgaaaagcgacaaagttgatcatccaaacacagcgcatatcgtgctgcaaaaaggcgaccaccggctagccgtgactggggtatcgattggcggcggtaatattcagattactgaaatcaatggctttaagatttctctgagtatggggcagccaacttatattacaattcatgaagacgttcccgggatgatcgcgcaggtgacgaaaatcttttccgatgctggtattaacatcggtaccatgactgtgactcgcgaatcaaaaggcgagcaggcgatcatgattattgaaacagacgactatcaagatgatattttggctaagttgaaacaattgccgcatatggtgaatgtcacttacttcgaatgacagtcgtttttaattgttgtccctgatgttttgataaaggagtcgcctatgttttataccgtcaaagaattgattgagcaaagtcacgcgtttccatctgttgctgcgttaatggtgcataccgaggttgaaaactcgacacggacggaggcacaagttcgccatcttatgagccgtaatctggaagtgatggaacgatccgtcaaagaaggcatcgccggcgtcaaaagtgttaccggtttgactggcggcgaggcgaagaaattagacgcctatgtcaccagtggtcagttcatgagcggcaagccgatcatggaggctgttcgcaatgcggttgctgttaacgaggttaatgccaaaatgggcttgatttgtgccacacccactgcaggatcagctggcgttttagctggtgttctgcttgctatgcgtgatcggttgcatctaagtcatgatcaacagttggattttctttttaccgctggtgcgtttggcctagtgattgccaataatgcgggaattgctggtgcagaaggcggctgccaagaggaagtcggttctgcgagtgcaatggcggcagctgcgttggtaacggctaatggcggtacggtggagcaagcagcgactgcagttgccattaccttacagaacatgctcgggttagtctgtgatccagtcgctgggttagttgaggtgccgtgtgtaaaacgcaacgcgctgggcgccagtcaggcgatgatttctgctgacatggcgttggctggttgcatcagtgttattccggctgatgaagtgattgaggctgtgaatcgtgtcgggatgcaattaccagcgaccttacgggaaacaggcgaaggcggcttagcaacgacaccaaccggattgcgtttgaaagaggaaattttcggtaaataatcattgtcagtcttggctatttcagggcgtgatatttgtggagatgccccaagctgggtgttagcgtcagttgcagtttaaacggaaacacaggaggagctcgtgattcatttctatattgttcgtcatggggaaacagccggtaatgtcagccagttaattcaaggtatcaccaattcgcaactcaatgcgcgtggccgtaaacaggcattggctttgggccgcgggttgcgggcaagcggtttgatgatcgaccgagtcgttgccagtgatctgcttcgagcacaggaaactgcgcaacaaattttactgggcatgcaggtaaagctggcaattgaaaccgacaaaggactgcgtgaagaaaatgatggcgtttttgaaggacgatcgttaaaggatgtttcacaggaggtttttggtgttccggattatcacattcttgtgcgcagcggtaaaatgccgctggaagcgattcctgatgggatacacgcagctgatgcaactaatcaagctgagaatacgcaacaagtggtttctcggtatgattttgccatgcgccgaattgtgacagccgcagaagctgcgaatgagaccaatgtgttggttgtcagccatggcacggccagtctcctgtggttacgagcgcatggtggcgatttgccaaatcggaccgaactcacgaatgccagtgttagcaaggttacctatgacaacgggcgatttaaggttgactggatggacaacactgagtttcgtgatcagggattaaaagaagaattatcataaaaatattgggaaagcatctgtaggcaagacggctatggatgcttttttaggtgcgcagttgtctatatgttaggaggctcggttaggttcatcaggacaaaaaggttgtgcgctatcgaaatttgccgttcgcgcgtatacttgccttaagatatgggctggcctcgtttttgtgaccgtgataacttagtaaaaataggcaggcttattcattgtcgttaacttgataagcacatttaaaaggagctggtgacatggagcaagacgtatttttagctaaggtgactaacttgatgcttgcaccgggaacgcgtgcatttgagcgcgaacaattgcgccaggccaaacatttggtagaggccgggcgaccagtggcggaaggctgggcgcaacttgaatcatctttgcggccattggcgatgcgtgataacctgaccccggatgtggctgacttttatcgagcagagaccggtgatccagtaggggctgtgcagacagatttgagtgcccattttgatcgcgacatgccgtttcaggagcgggctatttttgctggcggttgtttctggtgtatggttgaaccattcgtcgatttgcctggtatcaccgcagtcacttcgggttacactggcgggcatagcgcacatcccacttatgaacaagtgatcggcggctataccgggcatgttgaagccgttgaaattatttttgatacccgcaaaatgagctacgccgcattagtggcgctttattttcagttaactgatccgactgatgcactggggcaatttcaagatcgcggcagtcaatatcgtcctgtgatttttgtcaaagacgatacgcaacgccagatagcggaagcggctaaggctgaattggctgcttctgggcgttatttgcggccaatcatcactgcaattgaacctgttgcgactttttggccagccgagaactatcatcaagacttttataaaaagaatccgaagcgctatcagatggttgaacggacgcgccgccagtttcttcaatttcagcgtgcacaaggcaacctgcgggtgatgttgaaacggcgtaaaaaggcataaattcttgcagtcaaatggcagttgttgttgaaacggaggtagtggcctatgcgggaaccgatacgacattggacgcaaaaaaatatgcctgatcttcacggcagctatgcggtcgtaacaggtggtaccagcggagttgggtttgcaatgagtgctgctttgttgcggcacggggcgacggtgatcatcgttggcaaacaggcatcaaaaggcgtcactgctgcagccaagttaagggcgcaaaccggtcaacaaaatgtcacgtttatgggcgctgatctggcggatcaagcagccactaaacacttagccaaccgcctgctgaggatgcttcctaagctggatattttaatcaataatgccggtgtgatgatgcccgctaaacgtaccttgacccgtgacggtctcgagctgatgtgggcagtgaattattttgccggatttatcttaacaatcgaactgatgccgctactattgcgatcggatcatgcccgtgtggttaacgttgcctcaatcgccatgggtcgaccacatttgacctttaatcagtttgatggccatgactatcgcccttggacgatttatacgactaccaagctggcgcaagcgatgatggtggttaagctcaatcagctattgacagaggcaggacagtcggtgaccgtgactggctcaagtccgggattagccgcaacgagtttgaaaacaatcagctcaaggaaaactgcgtggttgatgcgaatgggtgcgttgagtttttgcttgctgccgtttctccggcaatcgccagatcaggcggcattgccagcactgtatgcggcaaccgaccccaatgcgcaaggcggcgtgatttatgcaccacatgcatggcgtggtttgcgaggttacccagcattatgggcttggaatcagcggcccgaattacacgatcagaagttgcttgatcgtttatatcgggcttcacgcaatgtaactggtgtatgactgccattttgggcacgttagattttctaagaagcgactttgctaatgccccaaaagcatcatttctgctgatcccatgctatttttgctgtgattagcgttgtgtaagcggttcacctaaaatggcacatgtagtggtgagcatactcgctaacaccaatatattgtatattcaagacttacatttaaaaaaatttgttgcataatagagcatagtcgttgtcagtgcaacgaaaacgaaagcttaagggagtcttgtttgtgcaaacatctgggaattattttagttggttgatgcatcagttgaaggggtggccgcagcagaactattatttgttctggtttgcttttgggtgtcagttgatgacccttgtagatgctaagataacgcccgtgactatcattacttttattgggacaactttgggtgtgctttgcgtcttggccattaatgccactaaagcagtcaatgggtggttaggtcttttgagtgccgcatgttttatctatgtcggctttatcgcccgcaattatctatcaatgtttgaacagctagcctatgtggtgacacttgatttgccagttttgattagcgttcggacttggaatgatgatactaagaacaacttgaagacattcaatgcccagaaatggatgctgtcaattggctttacgttgattgtgtgggcggtgagcgcctatttgatcggccagtttaccaatgatccgcggccaatttttgatggtatggcttttgcgatttcattgactggtgggattgtttgcttcctgcgatacaacaatcagtacttctggtggttgttcagtggcgtggctcagctcgttttatgggccattacttttgcgcaaggggatgccagtttagcgatggcgattaatgccagcatttacgtcattaatgatattttggccttcacggttagcccatggttcaatcggggccgcaaacagctgggtctaaaaacgatctaagtggtgctttagctgtgtttgtggtaatgtttgttgttggcgcaacataataaacataattgaggagcgagaactgtgatctacattttaggcagtattggtgcaggaaaaacgtcgctgacaaaagttttgtcagaagatatgcaggcaccggcatattatgaagatgttgaaggtaatggcatgatcgccaatatgctgcaaaaattttatggtgcaggcgttgagagtcgtaagcgaaccggcgcgatgttgcagattgcatttctcacgttccgttaccagcaattgaagaaggctgtgacccaagaaaacgcgatcatggattcttcgcttgaatcagacttcgtgatggcctcgcagttgcataaacacggtgaaatcgatgatgttgatttcaatgtttatgtgacactgtctcaagagatgcaaagtaatgtcaatggcagtccttggaacggttttcctgatctagcagtttatctgaaaattgatccagatcacgaaattgacgaaattcaaagtcgtggtcgcgatatggaagatattcgcgaaaagccggagttggtcgattactatcggcgggtcaacacagcttatcgtgattgggcgaaggggtatacgcgctcgtccatgattacaattgatcgtgatcgttatgactttatgcactcagcagctgaccgtgccagtgtgttagatcaaattgaaaccaagcttgttgatctcggcaaattatccccgcaagcgtttgatgcgttgcaagcgcaacatgcagatgggccgatttctaagtttgcatgatttccagttaaattgttagaaacaacgacctgtgtcatcctcatttttaggggataacacaggtcgtttttgatttgtttcataaaacatgttcacaaacacagcaactcggtcgattcacgcgatgccatctattttcgattgcaagttcagtctatgatatgcttatgttataagaagccatggttcgaaaccctaactatcattggttgtcagtagggtaaaggacactgaccccactagaaggaggaactcattcgtgacaatttatgatcagcacatgcataccttgtattcatttgattccgaagcccaactccgtgattacttaacgcagacaaaggcgcctgtcgtgacaacagaacatttagagtttgataatcctgatgatggcggccgggataatctgcctgattatgctaggatgaaggcaacgcaggcggctctggccgaaaaatttccgaacgaattcttgcttggaatcgaagccggctattttgctcctgccgatgctcgattccgacagtacttggacaaccatgactttgatttgacacttttgagttttcatcatgatggtcattacgattatctggatgagcaattgatcaccatgccagctaaacagcagcttgaagattactttgaacggatgctcgctggcctcaaacgatttcatgatgccgacgtcttggcacactttgactatgccttgcgccgatttgacatcacaccggaccagctagaagcttggggcaagccgttgttggatcaaatttttaccattgccgtcgaaaatgacttggcgttggagttgaatacgaagtcaatgtatcgctggggcaatgcaccactgtatgatcaggcgattgcttggtatcaagcagcgggtggtcacttgtttactattggcagtgatgcgcatgaaggaccgcaatacgaggcaaactttgctgatgcgctagcgatgcttaaacgtcacggggtaaaagaaatcgccacgtatcgtcaacatcagcggacaatggtaccgattgagccgccagtgattgatgctgataatgcttattaatggcaacagggtgaggacatcattcacagctttgaaaaataaagacgcccgatttttccatttgcagggaaaatcgggcgtctttcgttttctcatagataactgtcgggatttaagatctcagtgccaaggcggagcaatcgtaggccagatggggctcagccgtgaaaacaacacagcgaccgggcttggagctgatgttgttaggcgacttcgagaccgcaggttttgcgggctcgaagcgccgtctccgctttagcttcgcgtcgcaagccccagctggccggagattgcggggtttggcacggcaaaggattttttttagcctagattgtttcttcaaaacgccgtgaagcgcttatttcagataggcgtaaacaaagttgaaactgttgcccggactcgtcttcagatcatggatcttcggattaaccatgcgtgctgaaacgagttgatacagcgggatggcaccggcttgattgaccagcaactgttcagcttcagtcatgtccttgaagcgggcagtaggcttgttagcatccgcaccgttactcttggccatgagcttgtcatagtcagcattttgccactggccatggttgtattcactgttactcgtgaacaaatcgagataggtgttgggatctggataatccgccccccaagtactgaggaccatgtcaaaatcgtgggtggcagcgcgctgctgacggttcttagctggcacactggcgatactgattttgaggcctggcaaattctcttgcaaagcaccttgaagatattcttgagttgccttgactgcatcaacatcatcacctagcagctcaacatcaactgttttggtgccaacttctttcaggccttctgcccacaatgtttgagctttcttcttattgtaagtcgtgatggccttcgtgttcttggcgaccgctgtcgcataatcggtgctgctgtccggcagctggctgagatcagccggggtaatgtcacgggcgacaatagaaccgtcggctaacacatttttaacaaaagagtcgcgattgatcgccatggagatggcctggcgaatcttggtattcttgaatgccgggaccttattttcatttaattcaaggaagtaagtccgggcccgtttagtggcaacatagccagtcttgcccttttgttgggcagcgagctggccggttaaattggcatcgtcaagcttaccagtgcgatataggtcaagtgccgtattggtatccttaactacctgaacgtcaatttgcgtcaaatgaacattctttttgttccaataggtggtatttttaacttctgtccatttatcgccagtgccggtccagcctttggatttaaaagcgccgttcgacaaagtatattgcgacttggtaccgtacttggcgccccatgccttaaccttcttagcaggttgcgggaaaaacgcaacgttatttaacaagctattgaagtaaggaatcgggtgttcaagcgtgacttctaaagttttatcattaatagccttgatgcccagatctgttgctggctttttgcctgcacgaatgtcgtccgcattcttgatgccagagtacatgttggcctgagtggacttggtagctggatcaacggttcgctgccaagcaaaaacgaaatcttgggctgtaaccggggtgccgtcactccacttggcattgcgtaacgtaaaggtgtaggtgaggccattatttgtcggcttcacgattttggtcgccatggctggttgcaggtcgtgaccgtagtatttatataacccgttcatggtatcaatgatagcctgtccagagacaccttcagatgctttacttggatcaagcgtttgcaacacatcggcttccattcggtgccagacctgttgcttgctggaactagaactgtccttgctcgattgggtaccgcatgcagtcagtacaaaagtgagtgctgcagcagcaaccacaagccatttttgttgtgttttcaaatcatgcccctccaatttgtaagctgttactagaatagcaatctccttacaaaaagcaagtgttttgtatgaactgatgctttttgaatgacagcttaaaaacccagttcacgaatggactaggcaaaggcgtgatcttagacgttgtggtcgcgaaaggtgagcgtgacagcaaattgttgcctgtctgcttgcagcgtcattttcccgccaagcgtggtggtgagtgattgcacgatgctcagacccaagccgacgctttgggttgtccgagccgaatcggttgtgtagaacctgtcaacgagctggtcagcattcgcaagcggtttgtcggtgttgttggtgaaggtgatggtcaagtgctgctcatcttggcgaacgagcgtgacactagcctgattcttggcatattttagccagttaccaataagattttggaaaactcggcgcatcatcgtctcatcggttgttaaaacaagattgggcgcgatttttggggttacctgcataccattggccgtcaattggtcaaaataatcaaataattcagtttcgagtaattttgataagttgataggttttagctttaacgccgtggatttttcctgaatgagattgaagtccatcaggtaatgtaagtagtaattaacagaccgcaaattgtgtgccacgcgggccagcgattgtttggcgtcggcgtgcggatcgcgatttagaagttgaacgtagccagttgcgacggtcagcggggttttaatatcatgcgtcaaattcagcaacatctgatgaatctttttttcttgcgcaatttgctcaagccgcaactggcgggtggcattcagattgtcattaatcccagctgcgagtttacgaaccaaaggaaaattggtattggttgtcaccccagcgttagtctcgatgtgattaatataggtgagttcgcgattgatacggcggatatcgatgatgatcaacaaaagagtgatcgccaatacaagacaaatgacgctgagtccgatgatgataccaagcatagccttctcctttgaaaaacatttttcgattgctagcagttatccttaaaaatgatccgtagctaactagctatatcaaccgaacgccgatgccccagattgatacaatatacttcggatcttttgccagatcattgattttggtgcgtaaattgctaatgtgcacgttcagcgtattatctgcgttcatgaacggctcgccccacacctgctcatataattgttgtttgtcgaaaacttgatggggatcgcgcatcatcaacgccagcatcgcatactcttttttcggcagggtcagcggttgattgttgacagtaaccgcatgacgtttgagattcagcgtgatttcaccaacctgtaagtgatcttgtgctttagccgatggtgcaggcaacgtttgacgcaactgcacctgaacccgagccaataactcgtcaatgtcaaacggtttggttaaataatcattggcgccttgttgcagaagcgcgacagttttttgcttgtcttgaatggcggtaaggaccaaaactggcacgctagacgttttgcgaatggtcgtcaaaacactttcaccggtgacgtttggcagcattaagtcaagaataatcaagtcaggtgcttcctgatgaaattgtgctaaggcactgataccgtcataagcttggatcacagcgtagtagggtgataatacatctcttaacaaggcttgaatatcttgatgatcttcgacaattaagattttgcccatgctgtcacacctcctaaacgcgttcaccagcccagaaacctgcgtgtaaggaccttggacgcaatggccaaagtgcggccatcacacccaaggccacttacactccggtttctaaccgggctggttcacgctctcttaaacgcgttcgcagccgcagaaacctgcacataaggacctcaagtacgatggtcaaagtgcgaccatcgcacttgaggccacttatgctccggtttctaaccgcggctgctcacgctctctcctaatagtgtaagctataagagcagtttttcacaatttaggtttaattaaggattcattatatagccagttaagaaaggcccgttaagctgattttgtaagcaaaaagcggtgacaaaatggtggagggagattgctatgacacaatcagtgttaacgattgaacatgttagcaaacagtttgggcgttttcaggcattagatcaggtcagtttcacagttgaaaaaggggatatttatggcttaattggcgaaaacggggcgggtaagactactttaatgcggttgattaccggcttgtcaccgatgcagcacggaaccgtcacattactaggtgagcaagctggtcactatcaacatgcacttagtcgaattggagctgtgattgaaagcccagcagcgtttgagaagttgaccgtttaccaaaatttgcggttgtgcgcaattcaacatggcattcaagataaacaggccatcacggaagccattgattttgtgggactcaaagcgaagcaaaccaccaaagtcaaacatctttctttaggacagaaacaacgactaggtttggcgttagcgattttaccgcgtccggattttctgattcttgatgaaccgattaacggccttgatccttcgggtattatggaatttcgccaattattgaaacgcttgaacgaggagcagcagacaaccattctaatctccagccatattttaagtgagttgtatcaagtgtccacccgatttggcattattcatcatggacggatgatcaaacaactgaccaaggctgagctggataaagccaatcaatcaggcttagcggctaccgttgatgatacggcactggcagcacaggttttggatcaacatgggtatcaagattttgacatcattgacgatcatcatcttttgttgagacaaccggaagttaatgcagcgggggtgaaccaattgcttgtgaccagtggcgtgggtgttcaggatatcagtcatcaagctggatcactggaacaattttacatgcagttactggggcaaacagagaagcaggaggggcaagcatgattaatcaaattcgggccgacttctatcgccaaatccatacaacgggcatgtacatcatgcttgtgctgacgattatctatgcggccacgacaaccttgggacagagtgttggcggcgtgacagtgcgtggcgacagtggtcaatttgcccaagttgggggtaaatcgtggtcagttttaactggcattaaagtggcgaatatgggtgaaacgatgctactttacgtttttatcggcgtttttgtcattgttttcgggtatgagttcagtcaaaaggtttacaaaaacaccttaatctcgggtatctcgcggttagcgtttgtcctagccaagtatttggtgatgttactggacttactgctactattcgctgtcaatttcctaaccgtactgatggccggacttgttgctggacgcccattaggcgggagcttgggaacattgtttggaacctttagtctgagtttcgtggctgcgaccttctttgtgagtgtgatcttcagcattggcgtgttcctgctggtattaactgggtcgattatgataccggcgattgtggtggtggtcttccccctcattgttagtgtgctccatgtactcggtgagtgggactggattaaatatatcgacttcttcggcgtcgcccaaaatatcggcgtcggtggcatgaaggttagtgcattgccaccgtacatcgctgtcagtttagtgctattggttgtgatgattggctcgtcagcattaatgttgcgaaacaaagaactgtaactgactttttaagatttaaaaatgatccgcattttggctagttggccttgtgcggatctttttttagttgcctgctaaacagtctcgattaattggttgaaaatttccaaaaatttctgagcagcgccagacattgggacgtttttcgtccagattaaggccatcttggtggttagtgtcggagaaaagggaatgaattttagctgcatttcatcatggccgattaaatggctgagaccgacaatatacccggaaccgagttgagcaagcagaccagcattgtaaatcaagttgtagcgagccacgacttgattagggttaaaagcgtggccggcccaatcagtgagcattttgacaacaggttcgcgctccgacacgatcaacgcctgaccccgaatcgtttctggtgaaatagcggtttgcgccgctagcggatcagaaatggggatgagcagtccccagcgattttcacctggaatccggcgataggcatatttataagtgtcagccggatcaatcacgaccccaaaatcaagtaaaccatggtctaaccgctccttaatatcatcggcattgccgctgtatagctgcagtgtcacatcaggaaaagcagcgatcaattgttgcgctgcctttaacacaatctgattaagtcgtgactcgccaagaccaattgccagcgtaccgctgacggcatggtcatcgacaatgtctgcaaccgcagcgtctgtcaacgtgagaatttgtctggcgcgattcaccaaatacgtcccattagcggttaagcttattgcccgactttttcggttaaacagctttgtaccgagttctgtttccaactcctgcatttgccgcgacaaagcaggttgcgaaatatggatggcattggcagcggccgtaatcgtaccggcgtcggcaatcgccacgagatagcgtaatgttcgtaattccatgaaaaggcctccgatacataaggaaatatcataatactatatgctatataagcattatacattttaagccatcggaccgataataaacttaaacattgaaagaaggcattcgtcatgaatgacaagaatcaaaacgccggattattcggcttaggtgaagctaataccgcttaccaacagtattttacgggcaacagttatctgaatggtttggtcgccgcggcagatgagatcgatgtgactgttgccaacgtgacattcgaacctggttgccggaacaattggcatattcatcacaatggttttcagattttactggtcacaagcggtgagggctggtaccaggaagccggtaagccagcacaattgctgcatcccggtgatgtggtcacgattcatgaaggcgtgaagcactggcacggcgcaactaaggacagctggtttagtcatgtggcgatcaccaaaggtactagtgaatggttggaacctgtatcggatcaagcttatgcgcagctaacggaggaaaaataagatggcaaaacaaacagcaggacgcaaacagttgggaaaatttgccccacagtttgctgcattgaatgacgatgttttgtttggggaagtttgggcaaaagagaatgaactgtctgcccatgatcgcagcatgatcacgattgcttgccttatgaccagtggcgattttccacaactcaaagcccatttacaattaggaaaagaacacggactgacgaaagaggaagtcgttgctgaaatcactcatctcgctttttacgccggctggccaaaggcgtggtctgcgtttaatctggcgaaagaagtgtatggtgaatgataaacgtcctcatacttggcgctgccagtcagatttcacgctttttaattccagatttgttggcagataaaactgtgaacctaacgctatttgcccgccaagcaccgcaacggttggggcaatatgcaggtgagtcacgtgtgacgttggttgacggcgactggaatcaagaagccgatattgaacaggttatgccgaatcaagacatcgtttttctggcaagttccagtctcgtcggtaatcaaaatgttgtcacagcgatgaagcataccggtgtccaacggttgattgtcgcaggcggccttgggattgacgatgaagttgccggcaagtttggcaactggaatgcgcggatgatgggagattacacaccatacaaacaggccgcaaaggtgattttaaacagcggcttgaataccacttatcttcgcatgacatggttatacgacgaaaacggcaacgaaaagtatcaaatcgtgccagaaggccagccattgcgcggaactcaggtaacacgtcaagcagtggcgaagttagtgactgccatcgtgagacaccctagcttataccaatacgcaaatattggcgttgttgaaccggggactgagtgggacaaaccatcgttttattaaagttgcatgattcatctgaaccaccgatcaattcgcaaattagaattgatcggtggttttttgagatgctaccttgatgctagctgattagagcactggggttgtcattcaggatcaaaagaattacgcttgttctatgaatatcgaacaagcagatcaaacaatggcgaatatttttaaagttctaggtgaaccgcatcgaattgagattttgcgtatcctttatcatgctggtcgagaattgacgtgctcagaagtcagtgcccagttaaatttgagtaaatcgacagtgtcgtatcattttcgagctatgcgattagcgggcttgacgaatacgcgccaagtagcacaaatcaagtatctgtctatcaatacgacagcttttgatcggtttttaccggggtttttagcgaccctgtaatttttggcttgcttgttcgatattcatcgaataaaggagatgtaccacatgcttaaattattttatgcttcaggaaccagtgcaatggcgccgcatattctactgactgacgcgggacttaattttgagttggaaaaggtgaacttagatcaaaaaacttggcgcggtggcgattacgatcaaatcaacgccaagtcttatgtgccgaccttgcaaatagcgccagaacaatacttaacagaatgtgctgtgattttagagtacattgactttcaagcccgacaaaatgatagtagcaattatgccacagatgaatactggcaggagcgggtgtggctcaactatattgccacagaactccacaaaaactttatttcgccttttcggaagggtaattggctacctaatacggatgatagcaaacggttggtgtggcagcgagttgccccgcgactagcttatgttgaagcacggtttcagggaccatggctaatggggcagcatttttcaatgacggatccttatctgtttgtcatgacaaattggatgcaccggcttgatttttcatttgatcatttgccaaaattaaaggcctttgacgagcgaatgcgacaacggccaagtgtgcaggaagttctgcgggtggaagggaagccgcacagcgttactgatggttaatgcgggtgaagcagtgacgcttgtgtctttcttgtgtccgaacgacactattgacaaggtctgcttgaacgagactcatgcttcaagtaaacttgtcggtacttttacagatcattgatgttcaaaatgagtgagacagagccatcaattttgctgatagtaagctattctgcgatcacaatcaggagtaaactgttggatttaaatgaagactttttcaaacattatcattacaaaacagagttggtggcaatttgccgacagcatcgtttacctgctggtggtacaaaggcggtattaaatcagcgtttgcaagcattggtggcagggcagccgcttgacacaccaacgagcaaggttaaacgactggctaaacctgttaaggaattatcggtaacgacgccgctcgcgaactctggattttccttcaatgctgaggcgcgacaattttttgctgcgtactttcatgtcagcaagttcgcattcacaaagcctatggccgttctcaaacgtcaagcggaagcgcaaccccaattagcattaacggtcgctgatttaattgacgtttatcaggcaattcgcaattcaaaagctcgccaacaatttctcgcggaaaatgccgaagaaaaaacatatgaatggaatcgtttcgtccatgacttttttgctgatccggcgactaggcaatttcgaccgcgcctaaaggttgccgcgattctttggcaacatgtcaagcaatcaaccgcacccaagcaatacgtccatagcttgttgcaggcttatcatgaggatattgccggttacgttcaggcctcttcagagattgatcaatgaaacattgagcaatcatccacagccctcaaacaggccaacaatgccatatacagcggcaatgttggcctgcttcttatgggtaattattattcggaatctgaaaaagcacatgtcttaaaagagaatgatgactcatagtatttgttcaattcgctatttgttttctgtataatcgtaaccataagtaaacgaaccttcttatgattttttggcgacttggtaaaattactgcagggaatggcatttgggggattttggaggaaggaatgcaaattaaagcagggacggccgatcagggatgggctttagaagaaaaactggacgaatttaatcggcatcagcatcccttcaacggagcaggtgccgacgagtcatttgcgtacgtcatcaaaaaaggtgaccaagtggttggcggtgtcgcggcgagttcggatgacaatgcgattggttatatcgagttgctctgggtagatgaaacctttcggcgacaggggctaggacgtgtcttgttagcgactgtcgaacaaaacttgcaagctgctggttgcaaacgggtgcgattagaaacttttgattatcaagcaccagcattttatcgtgaaaacggctatcacgaatttgccaaacttaattacgactatgccggtgtgattgaatatttcttcgtcaaaatgttatcgctgccaatcggctacgacataccaccggctttttcaattgaagtagctgaagacctagcgatggaagccattgagaataagcttcacgcctacaatgtgaaaatgaaaccactactgcaagaaaaaatgggtgtgacttttacttttttagcggaagaaaatggccaatgtattggcggcattttcggttacagcaccatgtataaaatcggctatattgaaagtctatgggtagctgaaacgaacagacatgcaggtgttggcacggctctcgttgatgctttattaaatgccttaaaagattttggctgtccgattgttcacctcgataccatgtcgtatcaaggggcggcgttttataaggcacttggctttgagcaatttggccagctgacctacccggaaattgacgcagcagagttttttttcgtcaaacacttagtttcagttggagaaaggacaataaatgccaacaaataaaggtatcacagtcgctcgcgaagaagatccagatctaaagcaagcaattgtgcaggctgttttggccgatttgcccgaatggtttggcttgccggatgcaactaacgcttatgttgaagaggctgcaaaactgtctttatgggttgcttgctatgagggtcaggcgattgggtttatcgattatcgccaaaccagcaaggcaagcggcgaaatcagttgtatgggcattaagaaacactttcatcatcaagggattggccatcagctggtaaaggcattagaagccgacgctaaacaacatgcgcactacctgcaggtaaaaacggttgatgaaggtcattatcctgaatatgatcaaaccatccgtttttacgagtcagtgggatttgagcgattggaagttttcccgacattatgggatgcttggaatccttgtttggtgttggtcaagaagctttaataagcggccaaatcgcccagaacaaagtcaataaaaatcgccatgcctgacagaacagatcggctcgtgtaaacttgatatgcgtaagcgcattcaaaacgagggattagtatggtgccattctttcatgggtcacgatgatctcagaattatccacatccattctgttgtacaacgtcaagactcgaacaatgacagtagccatttataccgaagttattcgtggaaattacggcgttgccgctgcactatcaacgattttgaccgcgttgacagtgatttccttgctaatcttcatgaaagtttctaagaatggggatattgcgatgtaaccacaaaacttcgtcggaaataggacaaaagggagttgaccgtgactggttgactctctttttgctgtggaagcgacttttgttggcaaaactggctgaatattcacatgaacggaaaaagatatatgtggtgaacctatttacatctagtcttagaaaccatataatatggatattaaagccgcaaggaggcagaacatgaccaaaaaaattgcaattgtcgttgattcgggttctgatgtccctcaaagtgttcttgatgaaaataaaaatattgcagtcgtaccgctgaatattactatgaatgggcataattaccttgatgcagttgatatcacaccggatgaattttattcggcgctagcaacggcagaaacattgccgcagacttcaagtccgtcaccgcaagctgccaaagaggcgatggataggctgttcgcggctggttatcagcaaatcctcggtatcacaatttcgagcgcgttgtctgtgacgaacaacgtctttcaattggccgcgcaagattttcccgctgacaccgtaaccattcttgacacaaaaagcatcggcattggcagtggcatccaagcagcctatgccgcatcattgatcaatgcaggggaatcctttcaggacgtgattgcaaaagttcgtgcctcaatcgtcaaaagtcggatttatttctacgtgccaaccttgaagtacctcagtgccggcggtcgaatcggccgagtggcaggccttgtcggttcggttttgcacattaaaccggtgatctcatgtgatccagaaggcgtctactacccgctttttaaggcgcgatctgaagaaaaggcgattcagaagttggttgaacaagtcaaacaggattgcctaaatagcacccattatcgtttgggtgttgctcatggtcaaaatccatccttggttaaaaagttggcagaaaaattgcgcgaggtgactggtcgaccggttgattttattggtgagatttcgccgtcattgggggttcatacaggaccgggactgattggtgcaacgattcagtcgtattaagcgtcacgagaatgagccatgcttcatagacttgacctgaactgacatcaaattaacaatgcccgtttctcaatatgttgggaaacgggcattgtttgttttgcttgatagaatctgttactccaaccacttattcttcttagccatctgcactgcctcaattcgattatgaacaccgagtttactgaaaatagcagacaaataattgcggacggttccttccgagagaaacagcgatgcagcaatttgttttgaggataagccgctggcgacttctgccaaaacagcgagttcgcgatcagtaaggggattgctttcagcggtcaccatattcgtgactaattccggggcataaaccgtttggcccgtcatcacttttcgaataacatcaatcaaatcatcactggggctgtctttgagcagataaccattcacttgggcagcaatagcgcgttcaaagtaagctttctgcgcgaaggtcgttaagataataatttttgttgctaactggctgccatgaatcttatcggcaacgtccaatccggttaacttgggcatctcaatatctagaacggcaacgtccggtttgagttgctgaatgtcctgccatgcttttgcaccatcaccagcactgcctagtacgtgtagatcatcttccaagtctagtagctgggtgagggcggagtttaacatactttgatcttccgcgagatataaggtaatcattgtgatagctgctcctttggtaaagtgagtgaaacttgagtgccttggcggttgtgattaatcgtaaacgttccattaacttctttcatacgttgttgcatgccactaataccgtttgatcctgtgcgcttataacttttggaatggccatcatcttgaatctcaaccagatagccatttggattctgctcaaatatcatctctacctgatgcgcgtgagcgtggcggatgacattggtgatagcctcagaaatgaccgcactcagacgaatttgtacttttgtcggccattcagcggcctcactttcgccactggttagcagaacgacatttgcctcagcaagattcttgccttgcatcaacatcatttcgctgagggactgctggtgcagatcgttaacaatcgaacggactaactgtaagtcatctcgactagtttgtgcaatatcgtctaactcttgagcgacgcggtcaggcgccttcacgagcaacttttttgctaattcggttttaagcgtaatcatcgaaaagctctgaccgagcgtatcgtgcaagtctcgggcgattcgttcgcgttcaccgcgccggacaattgcttgaagtcgccgattggtttgacgtaattgccgttgatggataactgaccgggaaacagtataagagatgataggcgaaacaagtggaaaaatcagattaaacatatcaggattattgatattgataatcccgggatgaagctgattaacgcgccataaacttacaaaaatgattaaataaaaagccgcggcaaaccaacggaaatattttcgtggaaaacgggctaagataaaaggaacttgccaaccagggtaaataatcatgtaattgttgagggcaaaaatagagaaaatgcctgcaatggcgagttcaagcggaatcgtaactggcagccaatgatcgacctcgttcactaagatatagacaattagaaacaggatacctaaacctatccaaagccaatcattgattgattttactggcacaaattctgacatgatgtacggcaaatagaccagccaaatatagctggtccattcgagatttcttaaccatgaacggagactatgcctcacccaaagccacgccctttcgttgttcgtgtttggtcatagcaacaactagcaaactgccaagcacaaaccagaccacaataccaactaaattagttaagtctactgtagcacgtgaagtgagttgatttaagagcttgtttacaaagtaggttggcatctgtttgccaataacttgtaaccagtttggcagcatggtgattggccaccacaagccgctgataatcgccattggaaaggtgagcaggttactagcaagactgagcatttcttcgcgatggatatacgacaatgcgatgccgatcatgagcactggcagctgtccaatcaaaacgacaccaaggagtcctagccattggtcggtaccaaggctcacattattgacaccaacagcaatgctgcctaacacgatgactgagagtaaactcatcatgagcatccaaaaggtgattgacacatagtagggcaaagtgccatgcggagatagtcttagaaaggttgtgaaccccttatcgcggtcacgctttaagatggatgcaatgctgaagaaagcattaatcaaaatgctataaacaatcatctgatccatataactgatattaaaatatttaatttcagttgcagagccgctgatcatcattttggtatagagcaaataaaatcctgcgggcattaagagtgagaagaaaataaacgaagaattgcggacgactaaccgcttgccatcaaaggccagttgcgctaagagtgttttcatttttctgtctcctgtttagttaattgtaagaagatatcttcaagtgattcccgactgaggttgatttgatgcaaacgatcaagcattgggacgagtgacttaagcgtttgatcgccattgttgctatggatcgcaagtttggaaccgatactgtgaacctgatcaacagcagcgagtcctttaaagatggcaggttgcagatcggtttcaaaagtaatggtagcgcctaaatgctttttttgaagttgttggagtgagccgtcaaaagtgaaacgaccatcttgtaaaatcaacaaacgatcagcgacctgttgaatttcttcaagataatgactggtgatgataatcgttttcccttgttgccggagttgctcgattttgttccagaattctttgcgtgcagtggcgtccatgccgacagtcggttcatcaagaaagagcaaatcaggctgaccaattaaggcaacggcgaatgtaactcgacgtaactgaccaccggaaagactgccgagccgttgcgatttaagctgttgcagttgcagctcttcgagtaatgcagctggatcaagcgcatcaggcgtctcggcagcagcaagagtcagaatatccccaaccgtgatgctaggaatgatcatgtcgccttgcagcattgaaccaagtcgtgccttgatagcagttgtacctggttgttgatcaaaaaccttgacggtacctgttcccgatagtagtccgagcaagatattaagtaatgtggtctttcctgcgccgttaacgccaattaagccgacaatttcacctggctgaaccgtcaaattaatgtcttttaggactgctttatcaccgtagctaaattttaaatgttctgcttgaattactgtggtcatttcgtccacctccaccattgatactacgcggtgggtgggctagccagtagtcgcgaatgtcatgaatggtatgtgacaaatgtcatgatccctatgaaaaaagcctatctttgaatttaatcaagcacggtcaataaaaagcggctatctgaaagcttagtgaggcttcgcaggtagtcgctttagttgtagcacactataacggtatatccgcaccttgatgcaagcctttcttagtctgatcgaaacttttatcggacttaaaggccccaatgagctgccgcatgttcatgtcactgtcacggatttcaggcatggtaggacgcaaagtggtaccggaaaccgtgaggctgtattgactagcaagactggtaataggcgttttggactgatacatattgtagaaggcaacctgctcaccatcaatcagggcataaaacatatagtctgtctgattgaccgaagggataaactcagagaacacgatgagtttgctgctagatcccaggacgagatgataactgtaggtttcactagtactgtttgcgtagtcagcgacttcggattgttgtaagccgttgagggtccagtaagccgtgaagaacaaggccgcccggtcagcatctgtcagactcgctagctcactggcaggtgcaagtggtgctgttttcatagcatcaatcgggtaggtggtgtcggtattttgcgtccatgaacttgaagtggccgattcattggtgacttcggacgaggaacttgcagtggaggcactgctgctagataccgtccttggtaggcgcgtttgtgaagccatctctgacgcgactggcaaccagttaaaggcaccagttaaagccagaaaaatggcaccgaccatcaaaatgccctggagactgatccggagttgatattgtcgtttcaacaaatgcttcggcgtccaataaaggtccgttgcatcgctatcatggtcgtgatccgctttctcaagtagctgaaataaccactgcgtcaggtaaaaccagatcatgcgactgatcaacgctaaggccataccaccaaaaagaaagatgttttgaatctcgttgtttgaggccgcgagcatttcggctagtcgaagtccgaatggtgacgtcatcaggtcagcggaaaatacgtcttggtaatgcatgacaattgctgttacgaggccaattgctgcgagcacatccaaagcaatggcaacgagtcgccagttgcgtttgctaggatgagatcggtagataccgcgcacatagacaattcgggcaccgcggacttggctaggaaacatcatcttgtgctgctcaagctgaatatccacgattcggttggtgttgagatgttgtaacgcgatcactactaagacggcaatcagaaaaaggctgagaataaaatagaaaatcatggggttctcctttgctaaacagcggctcaagcagatggcgatcactggttttacagatgcggtgtaacgatcaaaaaagttgttgacagacatcatgataattagatctagaaatagcttgtcgatcattttctagtccttgaccttgatgtatactccaatgttattctgatgacacgaaaaaaggggattttcttatgaatattaggacatttgcgcaacaatccggtgttagcaaagatacgttgaggttttatgaaaagactggcttgattgtgccatcaaggggtgaaaatcattatcgcgattataccccagatgatgtggttaagttgcagatcacgcgaaatttaaaagcggttgggttgtctttaaatgaaatcagcatgatattgcgaatgtatgatgcgccagtgacaaaggcttgtcgcgaagataccttggccattttgcaaagttatcgcgaagtctttaaatgccgggcgaagctggatcttgcccttagcaacatagcgcttgatatgaccactgccattaaaatgcaggcaggggatgatgcaatgatgacattatttaaaaagataggggcacttaatgattaaaacaattgcagacgggattcgttttctgttagaaattgcaacagttgtgttattgatcatcgctgggttcaatagtagcgatcttgtggttaaactaactgtgggtgtgatagcgccggtgctcggcattcttttttggggtcggttcatggccccaatgtcgcttcacaggttgccaacaattggccgggtgataacggaaatacccatatttgggggaacgtcgttggcaacgtatttgctaacaacacataaagccgcattgatttatggcggcatagcattgatagatactttgattgagcatctaataccgtgagttgatttaatttaactggctagtaggtattttgtcttggttggtgcatacttaggggggaaatgctttgtccggaaaagctcacaacgtactgctttaaatcgggtcaggtcaacgaactgactgcccgactcatcggcatggcctttacctcggctaatatttttgacaccgacttgccccaaccgttgaccctcaatccttggcagctcacgtctatgctcgactttccactgaaaagcaaacaagccgttgtcatcgaaaacaacggcgtctttgctttactacaccaagaacatcccgactggccgttaatcttacagtctggcaacgactttaacgaggtttatgtccaactcatccaacgacttgaggcgcgggggatacgctacgtttatctcggtgatctcgacagcgccggtattcaaatggccgatcagtttgcaaagctgttgaagcaaacatcagccgaagaagtggcggcgttgcaacaaccaaccgatgttcgactttggttagccgatcttggcaaaatagacgctcgccgcaccaagcaacgcaaggtcgtctcgccggtctatcaagcagagatgacgacgattgcactttttgggaagtttattgagcaggaacagttgatgggggtttatgaggtgcggattgctgagtggcttgaaacgacagaagtttgatgaaaagctatttgataaaggccctatacacatgaggagaaactatggttacttacacaatcaaaaactatcatccagaaatgctggaaagttggcttcgttgtcgcgccttggcctatatgcgaagttcgtttcaagatgaaatcacggctgaaaaagagcatgtttcggctgacaatggcatctcattagttgccgtcaaggatcagcaggtaattggtattgccgaggcgatatttttagatcatggtgaggcaaaggctgagtcatatggtttgcctccaaacactgtgcttacaacacttgatacgctggcggtgcatcctgattatcagcatgtcgggattgccaaagcattgctgacacatttaaagaagcaactagagtcgcgaggcggcgttttgctaatttatacgctagatgatgaggcggcaaatggattatacaagacaattggcgccaaactttgttataaagcctcaattgttcatggccacagtccccacaatcacgtgccgcaatggactgattttcaggtgacaaaagatggagaagttactgtttatgatgaacacggtaatgaagtcccatatgggcaagatatggaaacatactatgtcggtaaggtcagaaacttcaaagagcttacgagtattagtgaaattgtgaccgagcatgtgtatacattggcagtctaagcaagatccatctttatgtattgataaatgattcaataaaccttgtttactgcaaaaattaagttcatgttttttcgttaaaagtttgatcaataaaatgaccaatccgtagtgatcgatctttgaggaccggttgaattttacttatttagcggctgttgacctagccaggtacaaaatatcttgcagaaccggtttcacaatagtggttgttgaataattcataacgtatgatggcagttacgcttccttttgtgcgaagaaaaagccagaaattcggttgaattcatctcacatgatgttatcccactgtgcttacattgggataattcgtgatataattaagttgttagataggaaggagtggttagcaatggcagccacaaagaaggaaactcgcttgaatattcgtgttgatcctgaattaaaaagtgctgctcaaatcgtagcaaatgatatgggcatcgacttgaccgcagctgttacgatgttcatgacgaaaatggtgaaagatcacgccctcccgtttaccccaacaagtctaccagttgaaaccttacaggcgctgaaagaagcaaagcacccagagctgctcaaaaaatacagcacgcctgatgacatgtggagagacttgaatgtatagtctggttccgacgcctacatttaagcgcgatctaaaacgactctccaagaagcattggccgatggacgaactaaagacggctgttaatctcctagccgctggtacaaatgctgaactattaagcaaaaagtatgcagatcatgccttgtcctcaagcagcgagtggaaaggatatcgtgaactatatgttgacggccctcgtggcgactggttgctaatctataaaattgagcagcaagatcttattttaaccctagttagaaccggatctcatcataaccttctggttaaatagaattacgaaaggccgtccaaaaagggcggcttttgtgttgtggtcaaccagcagattcattcgtcaatatacacgtgacttcacgccaatcttcaatcagcgattagaaatcgcgaactcgtcggcccagtaaaaatgttcagctatcgagatgagttgggtgatctggggaagtgagcatcaataagatgccaatctttatcatgcaggtttgggacgaaaatttagcccaatggtgacacggttcatcacttaaaacggtggactatgggttacaacggccaactaaaatatcgattatcaattctttggtgactaatagagtgaagctgccacctttgcctgacagaagaaatgcgttgattgggttcatcatgaaggcaaataaggcgacttatctggcgaatgaccgcggctttgatgaatggtatgtcaaacagtatgagcactggttggaacaggaagcttctgttggaaaatagtaagggttgccgatggccgtctatcaaattcgcacgaaaaccattttgctgggtaaaacgctgattttatggctttagttttgagatgagcgtaggttaagcttaagatgttcgtggatgactattagaaagttttcagtcacaggactagacggctttctagagcaaagcagtttcaaaacggcacttgaatttgcaaaaaaattgctaggggtggttgcagtgaacggcaaacttggaccaatgctttacaaggttggcgatatcgttaactggtcagacggcaccgagaaacatgtaggcgaaattatcattgctgattttggcggctcattggaaatgttgggagagcaacattcttatgacattagaagtgtgctgaatgggaaaccaacacttgtcaaacatattccggaagcttggatcaaacagcgactttcgactaaacttgaacgtcaaaaaggtctggaagagttgcgcgccaaggcagcacagtttgacgatgacgcgtctcggactgaatttgatcctgaagatggcttaaacatggccactccagatggatattatgaatttgaaacgtattcaggaagtcgttatcaagttgccattcatgggaagaatcggcaactgatccgaaaaaatgccacagccgctatgcgtcaggacggcgccgctatcgagatcatctatatggaaattatcccgggtcgatcgggctatcttgttttagaacctttgggggaaggcgaggtaacaacacgactgacttcgcaggtcgttcgtgtttggcgaatcgaaatttcatgaggcggcttactttcgactttttgccaaaatagtcggttagccacgcattgtgagtgcgtaacgctacctgacgatcattgtcataagcgacttaccttttgaaatttttcgtgatcgaatcaccgagccagagtggttactgatggcataaggttttatatcaggcaactggttgttataatggtgactgctgaataactaattatcttgactagaaatcgtgaggaacaacaacttgattgaagaacaaactgttcaattagtccaacaaagtttaaccggcatcaccgatcgacagatcaataccgttttgaatttgatgcaagaaggcaacacggtaccgtttatcgcgcgttatcgtaaagaaatgacaggcagccttgatgaagtacagattcaggcaattgaggaagcttataaacgtgcgactgctttgcaagatcgtaaagcggccgtcattaaaagcatcgccgagcaaggagcactgactgccaagctggaacagcagattcaagccagtaccaaactgcaagatgtggaagatatctatctaccatacaagcagaagcgccagaccaaggcgatggtggctaagtcgcgcggccttgaaccattcgccaaatggttgcttgcttttccaaacggatctcttgagcaggaagcccagaagtacgttgatccagccaaagaaattgccaccgtccaggatgttttagatggcgcccacgaaattttggcggagacttttagcgaaatggctccgattcgtaactgggtgcgcaattttaccatgcgcacaggaaccattagcgcgacagtcaaaacgaagggcaaagaactagacgaaaaaggcgtttatcagcaatactacgacttcgaggaaaccgtcaagaagatgtcctcaacgcgtacgttggcgatcaatcgtggggaaaaagagaaaattctgacggttaaagtcaaagtcgacactgatgctgtcctgcattacttccattttaaaattatcgacaatcggcccagtacggaagcaacggcgtttattgaggacgcttacgaagatgcatacaagcgatttgttgggccagcgattgagcgggaagtacggaatgcgttaacaactgatgccgaagagaaatccatcaaggttttcggccaaaatctgtacaacttgctgatgcaagcaccaatcaaaggcaaggttgtgttaggttttgacccggcataccgcactggctgtaaattggccgtcgttgatgaaaatggtaagttcttggctaaggccgtgatttatccgcataaaccagcaccagaaaaaaagcgtcaggaagccgccccagaactcattgcgctgcttgaaaagtatcaagtgacgatgatcgcgatcggtaatggcacggcgagtcgggaatccgagcaatttgttgccgaaacgttgaagcagatcaaacgtgatgttttttacgtgatcgtgaatgaagcaggggcatctgtttactctgcgagccaagaagcgcgtgatgaatttcccgacttgcatgtggaacaacgcagcgccatcagcattgcgcgccgcctacaagatccgctcgccgaactcgtcaaaattgatccagagtcggtcggtgttggtcagtatcaacacgacttgccaagcaaagatctgtccaatgaagtcgatgtcgtggtcgaacgcgctgtgaaccaggtcggcgtgaacttgaacacagccagttaccaactgttgacgcacatttccggcctatccaagaccatcgcaactaatatcgtgcactaccgcgatgaaaacggccgctacaacagccgtgcagagttgaaaaaggtgccacgtttaggaccgaaagcatttgagcaatcagtcgggttcctccgcattatcggcggtaaaaatccgttagacaacaccgacatccatcctgaaagttatccagtcgctaaaaaagttctggcggcagcaggtgtgaccgccgctgatttaggcgatgcagcagcagtcgctaaaattcgcgaggtgtccattgcgccattggtaaatgaaggggttggtgccgaaaccgcgaaagatatcatcaccagcttacaaaatccaggccgagacctgcgtgacaacatggccgcacctattctgcgacaagatgtcttgacaatggaagatctgaaagtggggatgaagctagaaggcaccgtccgcaatgtcgtcgacttcggcgcattcgttgacatcggtgtgaaacatgacggtctcgtccatgtctccaagatggcgcgcaaatttgtgcgtgatccaaaaaccgtggttgccattggtgacattgttgaggtttggattgagtcggtggatctggcgagggagcggattcagttgacgatggtggatccagcagtggggtaatggttagggcgaatgactgttaattggtgatcagggataaaaaaagaagcgttactttgatactggttagaaagcaaccatgtagaagtaacgctttttttcggctgtaccgatcactaaagtaacgcttcttgttctattatcccggttgtgaccatcttggccagctgactctccttgttcagattcaatccaaccaactttatcagtgaattaatagcaaggttcgttgccgtgccactttactaattgacagattcgtggcgtcaatgccagtaaactaagagattaccaaaaaccacttcaagcgatatgtgtggttgaattggctttttaccataagcaaggatctttttcgcagatctttgcgccgggaactgcattaggctgctggaaaatgcttgcttaaacttagaaaagaactttagttagattgcgtttcgtgatcggtgttgtctgcgaggcggacaccaaatgtgccctttttattaacttttgccgtatatgcgagatgataaatagtttcaccacgctgcatggcatcttgaatctttttgatctctgtttcagctgtcgctcttgtgtgataccagccaagttcagcgagacgggtagtccctagaaagcctcgatggcgactttcaccaattagaagaaaagaaggtgccgttttgctaggaataccttccgcaacttgaaagcccgtgtaactgcccagctggtcattgatcaaggaagtgatcgtgattgagtcgcttggaacacgagtagatggtgcctgctgctgtggttcgtcgccgagaagatcagcataagagatacctaagatggttcttaattgctcaattttatcaagatcaggttcggctaaatcgttttcatactttgatatggcttgacgactgataccgagggcttctgctaggtcattttgggagagtcctttttgcttgcgtaactgcgtaagtttttcaccaaacatttttctcgcctccttctatatttcaattatccgataaatttttgcaccatacaagcaatcaatggttgcagattgttaactggaggttgcgaaagtgagcaacgaggggtgattccaggaaagtgaggatcagattatatgttctgacgattctcgtgaaaaatacaaactcattctgcaataccaaaataaattggtctagtagttgacgttgaaacgcaatctgtttatgctaatcaatgcaaatttttatcaatcaacggacagcatctttgtggtgattcactaaccagaattgattggtattgataaaacttgcatcaattcagatcactcagtcggtgctaatatatagattgaataacaacatttcgcagggctgacttctttgtcacaaaaggttttagcatcacacaagaagttcagatattacaatggcatatgtggttaatatcaaacggtttcgtgataaaatttataccaaaaggaaatgagagactatggacgaagaatactttgaccggtacgggaaaatttttgggtactttcatgacgatgacttttttgcatggaatggtgcccatctaggattcaaagacgggaatgaactgtatcaggttaacgggaaatggagtggcttcttgtacaacggttttatttacgatgtacgtggttatccagttctatttcggcagaacgcgtttggtggcccaataaaacccattcgagctattaaacccgttcgtggcatacgtcaaattaagttcatacatggaattcgttcaatcaagcccattcgaccgattcggcagcttagttggtcaaactgtgatcctacagaaatatttggcaagtaagatgttgaactcgtcacccaaacctatacgcattggggtagtttagttcgaaggtaaatgcacacatttgagattgaacaaagtgtctgcaagtgtggaattattcctgcgtcttagcattatggctaacagttgtattggcaggaagctcaacattcttgatttttttaattttgctctgcgatttaataggtaaatttaataaatgtcatagaccaaccttactgtgaaaaagcctttttgtatgattgtatgttgatcttgcaaaaatattttgccataattccaaagatgaatataaagattatatataataagtgaaaatatgaatcaaatattttcaactgaacatcaacgtcacctttgtcggagcattttcgtataattttatttaatgtaatctcatagtttttaagtaacaatgaagtttgatatccgttagttcataatattattgcaacattgttgaaagtctaaatattttcgattgttatcacagggcttcaattttgcaactcaaaatcaacaaggatgttctcgctttcaccatgtattaaagatatattcgtttagatcagtcactgtcgccaccataggagcacaaagcaatggttaatcaaaagaagaccgaagagcaagctgtgaatgcaattaaattttatttcgattcagttgattttgtcgatacctcaaagattgcaataaatgacaaagaaccgggtcttgacggcgctatcgatgtttatggcgtcaaagattctgagcagttttctaaatctaacttaaagttttctatgccagttcaagtaaagggaacgaccaagaaaattacaaataataaacattctgttcaggtggttgatcttagtttttaccaaaagcactccaatggtcttgtctattttgttgttgccacattcaatcatgaacgacgaattttctttcggaagttggcaccccttgatattaaggaaattctggagaaggtcagacttgggaaagtggcacagaagactaaaactctatcattcacaatagttccaaatgatcccaaagctcttatcaacatattcagtgacctccatgcacaacaagagcgacaatcacggaatgttctagatttatccgaaatagcaggtccaactggtgaaatagtggcaaaagtgacttctcaaccgaaatatttagaagatactattcgcagtggtgtttatttttaccgaaaatcacttgactccgtgacaggtaagaacatactcatcccttactcatcagcaaaagtcgcagatatcttcgaattagaaagtggagttatctcagaccgtcgtggaaattcacttacgagtaaaatctacacgtctaaaaaaacaggacggaaagaacttctattgggctacaaagacagcattaaaatttcatggataccgaaacagaaaagtagctcacccatggaaaaggtacgaattcatttcacacctcgtggagatttctctcaacgcttagctgatgttagccttttgcttgaatatcttaggactccaacaaaaccgacatcgaaagaggctgagaagtggaataccttcattgacgcactaactcaacaagaagccagactccgggctattatcgaagatctaaaagtattgaacatccccatttctttaaatcctgacaatctaaaggatgatgaaataaaaagtttaaataatcttcagcgggtgttgcacaatgatttagtcgtgaagccattggatcaacatgtgaatatgaccctcgccagcaaaaaatatgatttctttattcatgaaaatcgtattatcaattattttactcctgcatttccaaaacattatatagtgcagatcgatgatgagaaaggaaatcctactattgttaatccttacactggcatttatgaaaaccttgagcaataccctaatttttctattgacttagttatcaagggtttcggagatgcgccctatgataaacctgaaattgcaaattattacaaccaatatgtcttgaatctgttgctagattttgatcgatcaggtgaagcaaaaatattgtctcttgctgaaataatatttaaaaaagttgaaaacaacttgcctagagaaattgcaaccataaattcggcacaaataaagaaaagaatctcgggaattcttggcttgtctgctctgaaatctctgatccctttaactgacagtaaagatcaattgattcaatttgctgcttttgtgttgcttgagcaaaaggaagaggttttgaagaggtggcaagacttctctccagatcagcaaactgagatgaaagagtggccaatatttcacctagctgcgccaatgatttcatgacgtaaacttagaattggtgtttgtgctttttaaagaagattttaaccttaattaaacaaaacaagagaatttaatcgtggttcaaattgctttttagggtgtccatttgctttacattctccactagtcctaaattgggaaatgtcaaaacaacttataaaagggaaaggaatattaaaaagtaatgaacacattatccaaaaccaatccgaaaagctaacaaagctcaccttctgttaaagggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaataccagaccataatatcaaagttgcctttgttcgtcatgaatatcgcggcaacggggtacgtcgccgccagtatcatgtgattgatgccgagctgacttaccggttaacccggtgcccactgtgtggctttgaggccttgcaccctaacgggttttacacggcccacgtgcgcgtcctcaatggggttgaaatgccgacagtcattgacttgcacaagcaacgatggcgctgtcataactgttaccacacagtcagtgccaagacgccactcgtgcaacccaaccacacgatcgccgctcacatgacagagcgaatcatgaagttagcgcatgaacggttgccagtcaaaaccatcgcccgtattatcgggatctcagcttcctcggttcaacggatcattgaccaaaatctcaaactccgaccggctcgccggctacccacgcgactctgctttgatgagttccgttccactcatggcatgatgtcgtttatctgtcttgatgccgattcacatcgtctgattgccttgcttggtgaccgattcaaccgcacgattaaaaacttcttcatcgctcattattcactcgctgaacgcactcgggtccagacggtcaccatggacatgaatgcagcttatcagacgattattcatgaggttttccccaaggcccaagtcgtcattgatcggttccatatcattcaacttgcggctcgtgcccttgatcaggtacgcgtccaagcgctcaaacagcttgatgacaaacacagccgtccttataagatcatgaagacaaactggcggctttttcatcaaactgcgcctgacgctaaacacaaacagttcctgtttggtttgaatgaagacgtcacgcaacaggaggccatcgatattgcacttgatactgagcccaagctcaagcaaacctacgagacctacttagcgcttcatgatgctttgatggtgaagaaacatcccgcggaactggcaaacctgttagctacttacgagccaaacggtacggcaatggacatgacgatcgcgacgcttaagcgacacaaagtcgctgttctcgccgctgtcaccagcccttattccaacggtccgatcgaaggggttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttgacgcagagccatattaaagtcgaaacaaatacgaaatacgaaaaaacacgcccaagatggacgtgttcgacaattgtttgacctattgaactgagtgcacgaaactgcacgagatagatcgctacaaacgttgttgtaacggtatttgtgcccaaaagtattaaagcttctggttatagtattcaacaaccagtgattcgtcaacttctggttcgagttcgccacgttctggtaaacgaacgagggaaccggtcttcttagtgtcgtcaaaggtaacgtaggccggacgggaaacggtgttctcgatggcttcattgacgatagcaaggttttgtgaacgttcgcgaagagcgatcacttggcccggctctacttcataagaagggatatcgacgcgcttgccatcaacggtgatgtgaccgtggttaacaagttgacgtgcttgcggacggctggaagccagacccaagcggaaaaccagattgtccaaacgggtttcgagcaggatcatgaagttatcaccatgggtaccttctttgatcttgccggcgcgcaggaacaagttctggaattggcgttcgtttaagccgtacatccaacgtaacttttgcttttcacgcaattgttggccgtattcagagatcttacgacggttgttggcaccatgatcaccaggtgcataaggacgacgagctaattctttaccagtgccggaaagggagaggccaagacgacggctctgcttccagcgaggaccagtataacgagacatatagatattcctccaagattttatttggagtaaaataacgaattgcggctttagcacacgggcagtcctgcaaaggttcacctttgcagccgcggttactactgtcaccggcttaacgccgaggcaggactggagccgaccatgccggccgctgctgcattattttacacgcgtgctagtataccgtgtttagcgcagcagtgtcaaggtgcgccgccaacgtctcaccaaacttagtgaggatggcttcgtcattttcactaaaccgatccagtgttggcgagtcgatgtccatgatggcgaccacccgattgtcaactgtgatgggaacaacgatctcagcgttgctggcagagtcgcaagcgatgtggccagcaaattcgtgaacgtttggcacgcgcagcacagcgttttgggcgtagctggtgccaacgacaccgttgcctggctgaatgtgcatgcaggcgactttaccttggaatggcccgaggtcaagctggccagttttatcattataaaggtagaaacctgcccagttgaggtcagtcatcaagtcgtttagcaaagcgctggcattggcaagtaccgtaattgggttagtttcgccggttagcaagccgtctaattggtcaacaatgatgggatcaagggtcgtcatttaatcagtccttttagagaatttatgaaaagcgatgtgtaggccttttaactgaagcctttttttgcgatacttgtacttaggatattctcacattttgatgcttaacggcattttagccgtgaagctgtcaaaatgcaattgaaatgataataggtaaagcagagggtgtagggatgatctggttctttgttatcgtagtgatcatagttgttgctgccggcggtgtctggtggctgcagcattattttcagactcgaatcaagaacttggacgcgcaagtcgaagcgattgacgttggtgcgctgtcgagtcagattcgcagcatcgagcagttaaagttaactggcgatagtctggcaacgttcagcaagtgggaacgggcctttgatcagttgaatgatgacgacttggctgacctacagaagattctgcttgatctggaggaccaggccaagcgttttcgctttgatcatgcccagaaaattgctaaggtgctggaagcaaaaattgacacagcccgccaacaatatgacttgatcagccaagccttacaagacattcggcatgacgaggcggataatcgcagcaagatgttgcagttacgtgatgattatcaagtgtcgcgtaaaacgatcctcgccaaaagttttgtctttggggatgcccagccggctttggaacagcagttgcaacaacttgctgaactttttcaaaaaattgaccagattaataatgatggcgatcatcaagctgccaagagcgagattaagcagttaagtgatgagatggcggcattgcggcgtcaagttaaagaattgccaccgcttgtcaatgaacaggtgaacgaattcccggcgcagattaatgaaatcgagcatggctatcggcagttgacaacggctcattatgttttcactgatgatattccgggcatggtcgaggatgttaacgaaaagatggctgacgctaacaccgcgcttaagtcgcttgatgtggacgccacagaagcggctaacagcgaaattgaagctgagattgataagatgtacgcgattatggaaaaggaaatgcaggctagaaagcgcgtcgatgctgctgcgccagacctgcgccaatttattgatcacgccttgcgtcaaaatcgcgagttgcagacagaactggatcatttgaatcagagctacacgttgaatcacaatgaaatcaaaattgccaaggatttaaagacgcagcttgattcgattgatgccaactatatcaaggatacggatgcgattgaagctggtaaggccgtgtattctgatgtgattgagcggtttgatgccaccaaagatgagttgacagcgattgagaagcagcaggttcaaattaatcaagcggtcgcaggcttaaagaaaggcgagattgtcgccaacaagcaggcagagaattttgaactggatatgcgtaacatcaaacatgaaattttacggcatcacctacctggtctgccacaagattatgtgagccaggtcaagcacgtcactgccgagatcgagcaattaaaccatgatcttgatcaagtgaaaattaacatggacgcgattgcgaagtttctggttaaaattgccagcgatattgatgcgttgaaaaaagcttccagcgctttgattgacgctgcgggtttgacagaagaattgatgcagtatgccaaccgctataaaacaacagtgaaaccagtcgccgaagcagtgcatcaggctactgagtcgtatatgcaatttgattataagcaagccgcggataccttagcgacggcattggagcaaaccgaagccggaagctataagaaggttgaggatgcgtaccttgcgcggaagaaagcttcattatattagtgattcggatttgggaaaaccagccggtggtggctggtttttgtttggggtcagattctgtgggtaaattttgcagaacttgttgtacgaacttgctgatgctatctaggttccgataaaggtgctcgtggatcaccgtttgtttcttcatagatagcttcttatcgggatttaaagacatcagtgccaaggcggagcagatggggctcgaagcgccgtctccgctctagcttcgcgtcgcaagccccagctggccggagattgcggagtttggcacggcaagagacttttggcttgatctagtgaagggagctggtttaaccgctcctgcttctaatctcagaaacgcgctcgccagtccagaaacctgcgtgtaaggaccttggtcgcaatggtcaaagtgcgaccatcacgcccaaggccacttacactccggtttctcccggactggctcgcgctcttgaaacttactaactttttgtctataattcaacgcagtcacaataacggaaggggccggcagatgatttattttgataatagtgcgacgacgaagatttcgccggaagcattggctacttataataaagtcagcacggatttttttggtaatccgagtagcttgcatgccttggggacacgggcaaatgaggttctgcaaagttcacgggcgcagattgctcagctgatcggtgcgaaaccaaacgaaatttacttcaccagtggtggtaccgaaagcgataattgggtgatcaagggaacggcgatggcgaaacgtgaattcggccggcacctgattacaaccagcattgagcatcctgcggtcattaatacgatgaagcaactagaaaaattgggctttgacgtgacctatctgccggtcgatcatcgcgggtttatcaacatcgatgatctcaaagcagcgattcgcaaagatacgattttggtctcgatcatggcagtcaacaatgaaattggcagtatgcagccgattgttgaagctgcacgcgtgctagatgcctatcccaacattcattttcatgttgatgctgtgcaggcagtcggcaaggggctggatgctgccttgcaagatccacggattgattttatgagcttttcggggcataagttccatgctccgcgtggcacagggttcatctatgccaaagaaggccggatgatcgcgccattgctgacaggcggtggccaggaaaatgactggcgctcaggcacggaaaatgtgccagcgattgccgcaatggcgaagtcactacggctccttttggccaatgaagcggataacgtggctcgtcagcaagctgttcgcaaacgaatttacgatcatgttagtcaaaagccaaaggtgacgatgttcagccaattgacccctgattttgccccgcatgtgttgtgtttcgcgattgccggtgtccgtggcgaaaccattgtccatgccttcgaggcaaaagacatttacatttcgacaactagtgcctgctccagtaaaaaaggtacggaaagcagtacactcgcggcaatgcataccgattcccggattgcaacgtcagcgattcgtgttagcttagatgaagcgaatactttggccgaggcagatgcttttaacaaggcatttgatacgatttatgcaaagtttgctaaacttgataaggcgaccgtttaactgaaaggattatagtatgcaatattcagaaattatggttcgttatggcgaactttcgacaaaaggcaagaaccgtcaagcctttatcggccggttaaacggcaatgtcacccgtgccttgcacgagttccccaaactcacgattcgccctaagcgtgatcggatgcatatcgaattgcatggggagccgagtgatcaggtgatggctcggttatcacaagtttttggcattcaaaatttttcaccaagtattgcggttgaaaaagatatggataaggtacatgcagttgccttgcaattaatgaacgaaaccgcgccaaagggcattagctacaaggttaacacgcgccgcagtgaccacgattttgccttagatacaaacgccatgaatttggatctgggtgactatctgacagataagcggcctgatttggttgttaaaatgcatcagcctgacatgattttgcggattgaagtccggcgcgaggcgatttatttgtccacgaagaccattcaaggggcaggtgggttgccagtcgggactgccggcaaagcagctttgatgctaagtggcggcattgattcgccagtggctggctattatgcgttaaagcggggtgtggacattgagatggttcactttttcagtccgccgtacaccagccagcaggcactcaacaaagctaagcaactgaccgcgaagttgacgccatatgtcggccggatttactttatcgaagtgccatttacggaaattcaagaggaaatcaaggcgaaagtgccagaaggttatctcatgaccgttcaacggcgattgatgttgcggctaacggaagccattgctcagcagcgtggcgatctcgcgattttcaatggcgaatcggtcggtcaagttgcctcgcaaacgttggagtcgatggcggcaatcaatgatgtgacaacgatgccgattattcgaccagtggcaacgatggataagaatgaaatcattgccgaagccgagaaaattgacacttatgatttgtcgatcatgccatttgaagattgctgcacgatttttgcgccgccttcaccgaaaactaagccaaagacggatcgcgcgcgttactatgaaagcaaaattgatgtcgccggcttgatggatcgcgcactggctggcgtgaagattcaggagatcaagtcatcggatcaatttatgaatcaagatcaagatgttattgctgaattgctttaaaaagaatgcctgttgtttgcctattgatgatagtggtcatggcaaacaacgggcgtttttatttaataaaggaaacatttcacaaaaactgagacttttgacggttttcatcttatggttatctgtggtgataaagtcagaagcacagaccaaactgcccggtcgctgacagataatatgataacatcagtacaatcctaacgattcatgccagtcattacttttgaaaaaagatagccaagcaagccgaattctggtaagctgatatgtgaaaagagtaacaaaagcgtgcggaggtgttcaaagtggtagtcagcaagcaggcgttatcacaggcaacaattaaacggattcccgtgtattatcgaacggttaaagacttgcagcagaccggcgagaaacgggtgcggtctgatcgattaagtaaattggtgcacattgccccagcaacgattcgacgtgatttttctaattttggcgatttaggccgaagtggctatggctattcggttgacttgcttgcacaggtttttggcgagttgcttgaagtccactcagaagaacagatggcgttggtgggttgtggtaatttgggccgtgccttgctgacgaataattttcgccgcaaccctgatctttctatcacgatgggctttgacaccgatccgcaattaatcgggacaacgattgccggcgtgccgatttatgatttggccgctttatctgaaaaattgcgtccgagtatgcacaccgctattgtctgcgtcccaagctcggcgcaagctgcagtggtgcgccaattagaagcgcaaaacgtcactgccattttgacctttgctcccaaaccggttcctgccaaaccgacaaccacgattcgctacattgatctcaccagtgaactgcaagccttattgtttgtcgatcatcaaaagcaggttaaacgagtgtcgcaagggtagcacaactgagccgtagcaggctatgtttccgaaaaggatagcgctagcgattgacccgtcaaaatcaacgggttataattcagctaatgcaatgatcaagagggtcatggtctttttttccagcgacaaggtggttggtgcaaaccttgaaaaaggctatggttgtagcttgtgagctgccgtcctgaagtgagtagggagcggccggtgacagccgttatcctgaaccaagtgggggattgtttcccaatttaggtggtaccgcgagctgactcgtcctaatttttttaattagggcggttttttttattctcgtaagtcagcttgcgggccgcgttactgcaggaacagaaaaaaattgtgaggtggagccaatgaaagagcaagcattagcacctaagtacgatcataaggccgttgaagctggccggtatcaagaatggctagatgaggatgttttcaaaccgagcggtgatcaaaaagccaagccatactcgattgtcatcccgccgccaaatgtgacgggtaagttgcacatgggccatgcttgggacacaacgctgcaggatattgtgattcgcgaaaagcggatgcaaggttttgatacgttgtggctgcccggaatggatcatgccggaatcgcgacccaagccaaagttgaagctaagttgcgtaaagagggcatcagccgctatgacctagggcgcgataaatttgttcaaaaagtttgggaatggaaagacgaatttgccaagacgattcacagtcagtgggcgaagatggggttgtcacttgattacagccgcgagcgtttcaccttggataagggacttaacgaggctgttcgtaaggtcttcgttgagttgtataagcaaggcctgatttatcggggcgaatatatcgtcaactgggatccgcaggcccgtacggcgttgtcggatatcgaagtcattcatgaagatgataaaggcgccttctaccatgtgaaatatccgttcgcagacgggagcggttatattgagatcgccacaacccgtcccgaaacgatgatgggcgataccgccgttgctgtccatcctggtgacaaacgctatcaggacttagttggcaaagagctgattttgccgctggctaatcgcaggattccaatcatcgaggatgcgtatgttgatccagcatttgggacaggggcggttaaaatcacgccggcacatgaccctaatgactttcaggtaggaaatcgccatgacttgaagcggatcaacacgatgaatgaagatggcacgatgaacgaaaatgctggcaagtacaatggcatggatcgttttgaagctcggaaggccatggtggcggatctggataaggaaggtctgttactgaaagttgagccaattgtgcatagtgttggtcatagtgaacgcaccggtgttcaggtcgaagctcggctgtcaactcaatggtttgtgaaaatgaagccgttagcggaggctgccatcaaagcacaacaggaagctgataaaaaagtgaccttcgtgccagatcggtttgagcacacctatttgcaatggatggaaaatattcacgattgggttatttctcggcaactttggtggggtcatcaaattccggcttggtacaacaagcagactggcgagacctatgtgggcatggaagcaccaaaagacattgaaaattggcagcaagatccagatgttttggatacttggttctcaagtgctttgtggccattttcaacgatgggctggccggataccgattccccggattacaaacgctactatccaacggacacattggttaccggctacgatattattccattctgggtggctcgaatgattttccaagggctgcatttcactggcgagcgtccgttcaagtacaccttgatccatggcctgatgcgagacgaacaaggccgcaagatgagtaaatccttgggcaatgggattgacccgatggatgtgatcgaaaaatacggggccgatgctttgcgctggttcttgattacagggaataagcctggtcaggatactcgctttagttacaaacaagttgaagccgcttggaacttcattaacaaaatctggaacatctcccgattcgtgatgatgaatctcggggacttggagaagccgcaacaaccagatccaagcaccttcgatttatctgataagtggttatttgcccaattgaacgaaacgattaaacaggtcactgatttatctgaacgcttcgaattcggcgaaatgggtcggactctttataactttacttggaacgtttttgctgactggtatgttgaaatgagtaaagaagtgctttatggcgatgacgaaaaagcgaaggcagcaaagcgagttaaccttgcttatgcgcttgaccagattctgcgcctattgcacccagtcatgccgtttgtgactgaaaagttatggcttgctttgccacacgcaggacagtcaattgtaacagccagttatccagttgctaatgatgcttttgaaaattcggccgctgttgatgccatggattcaatcatcgctttgattcgtggcgtccgtagcattcgtaaggatgcaggtgcgccactcaagacgaaggttgacattattgtcaaattaactgacccggctttgaagccaatttttgaggacaactttgactttattgatcggtttgtgaacagcaaagctttcacagtaggaaccgatgttgccgagcccaaaatggctggcagcaccgtgatcacgggagcaacaatcttcgtaccgttaaatgaactggtggatcttgatgaagagcgggctaagttgacaaaggacgctaagaagcttcagcaagaaatcgatcgcatcgataaaaagctgaacaatcaaggcttcctcgccaaggcacctgaggcagttgttgaagaacaacggaccaagcgcagcaattttgccgatcagctgaacagcacacagcagcggttggcacagttgcagcaggcttaatcaagtttcgctttaaggtaacgatcagattgacgttggtttgctttttgttaatagattgattgaaaaggggactgaccatggtaacatggccagtcctttttgtttgcctatagacggctgacgattaaacgcttttggcacaaggttacgtctagttatcattcaaaaatcactgggtaaacatcataacttctccagaatttctggtatcatgaaacttatgaagctagcacttgcacgctggcatagaaaccgggcgcgttcatgccctgaggaaagaagttaaccatggactacaccgaaagtgtcgcgtatattcattcgtttccgcgcttggccaaaactggcgatcatcagcgcattctcaccttgttgcatgccttgggtgacccgcaaaaacgaggccattatattcatgtcactgggacaaatggtaaaggctcagccgccaatgccattgcccatatccttgaagcaagcggtttgagtgtcggtttgtatacatcaccgttcattatgcggtttaatgagcgcatgatgattgatcatcagcccattcctgatgctgagcttgttaaagcggtcgctgtcggacaacaggccttgacccagctgcggcaagcgacaccagatttcggggtcacggaattcgaatttatcacggctctggccttttggtattttgatcaaaaacaggtggatttggcagtgattgaggtggggattggtggcgacacggattccaccaatgtgatcacgccggttgtaagtgtgctgactgaggtagctttagaccatcaaaaactgcttggcgatacgattactgcgattgccacgcataaagctggcatcattaaaccgcacgtcccggttgtgactggcaatttggtaccagatgctgatgctgttgtggcggcaagggttgcagcaacagctagcacgtggttgcgatttgaccgcgacttttccgttcctaaagcgcgcttgcatggctggggtcagcgattgacttatgccgacaaggatggcgagctgacagacatagatataccgctggttggtgattaccaacagcgaaatatggcaattgcgattcagacggcaaaagtctatgcctctgcaacgaattggccgttgaagtcgcaggaaattcgccaagggctagcggccagtcgatggccagcgcgattagagaagttaagtgacgaaccactgattgtgattgacggcgcccataatccggacggcatcaagggattaattggcgcattgcaccagctctttaagcaaccggtgacagtgattgctggcattttggctgacaaggattatcacaccatggccgatgcactaacgaaggcgtttcataccgtgtatctcgtaccggtaccaggcaatgctcgggctttgcctgaggctgggtatgcagccttgcatgaaggccaattaaaggattcctggcaagaagcaatggccgcgagccttgctgacgatccggatcagccaatcatcttaaccggctcgctttatctggccgctgatgttcgacaaactttaagagcgtgagccaacccgggtagaaaccggagcataagcggccttgaagtctaaatggctgatccttggccatttagacttcaaggtccttatgtgcaggtttctgcgcctgcgaacgcgtttaagaagagccgagaccagctcaattagaacagcgcgtgagcagttttttgtgtcacgagcgactttaaggaggagaccatgacgactaccattatttttgatcttgatggcaccttggtgaacaccgaggcactttatctcaaaagcaatgtcaaagctgccgctcaactgggattgcatcgcactgaggctgattttcggccgttagtgggtgcagccggccccagcgaggccaaagtgattgccgacatgattggcgccgaacatgctgcttggtttcaaaagttttcgacggcggatgttcttgatcaaattcaaggcggtgcagattttgttttgccaaatgtacagccaactttagcggcattgacaacggcaggttatccattggcgctggcgacgagtagtccgcagcattatgtggatgttgtcttggcagcaaccggctggcagcggcagtttcacccgattttgactggcagcgatgtacaggcgcataagcctgatcctgagatgtacgaagcaatgaaagtcaagctgggaaatgtgccagctgttgtcgttgaagatacccatgttggtgttgaagcggctgttggggctggcctgccagtggtcatgattcctggtattgcgcaaaaacccgattcaaaagcgaccgcgattctgtcatcaatcagcgaattaccagcttggttgaaaaatcagcctgcgtttgcgtaattttctaatgacaccgataactgatcggtgaagtgagaaaatgccaacagggggaattttcatggcagatgcagcagaattgccacgtgaacggttattagcgcatggtccgcaggctttgacggatgctgagcttttgcagctggtggtgcgagcagggaatcaacattatccggttaagcagatcgtgagtgaagttttggcgacttatccgaaacttcagggcttggcagaaggggatcaagggttgcttgagcatattcggggactgggcgctgccaaacgagctagtattttagctggggtggagttggggcggcgggctatgcaacggcagacggttcgctacgggcaaatcaaaaatagcgaacagttaggcaaaacgatgatttctcggtttgctggtgtgaatcaggaatccatgttgattttatttttagatgttaagaatcagattattactgaacagattgctgcaattggtacagtagattcagctatggcagatccgcgtattgtttttagagaagcgttaaagttgagcgccacaaacctgattatggtacacaatcatccgagtggtgatccctcgccaagtcaggcggatcgggacaccacgactcggtttcagttggccgccgcgttgcttggcatgcatttgattgaccatctcattgttggtggggaacgctattattcattcgcgcgcgatgatccggagttcaattaggcaggggaacaaagttgtaagcttttctcaaattgcccatctggcatgaaaatcgggtagtttcacattttgtcacagaaataaatatgctataatgcatggagttatacgaaatgagtcagcataaggggagaacgtcttgtttggatttggatcaaaaaatatcgggatcgatcttggcactgcaaataccttggtttacgttgacggtaaaggcatcgttttaaacgaaccttccgttgtcgcgaagaatacccaaacggaagaagtcattgcggttggtgaagaagctcgcgacatgatcggtcgtaccccgaccaatatcgtggcgatccgcccaatgaaagatggggtcatcgctgactacgatacaacggcagccatgttgaaatacttcatgcaaaaggcgctcggcaacggtagccatccgcaggtcatgatttgtgtgcctagcggtgtgaccgaagttgaaaaacgcgccgtgattgatgcggctaaagttgctggtgcacgcgatgcattcgtcattgaggaaccttatgctgctgcgatcggtgctggcttgccagttatggatcctaccggcagcatggttgttgatattggcggcggcacgactgacgtggcgaccatctcacttggcggtatcgtgtccagtcgttctattcgagtggccggtgacaagtttgatgaagcgatcatcaatcacttacggcagaatttcaacctgttaatcggtgagcgaacagctgaagccatgaagattcagattggctctgcatctgttgaaaaggcaaaagatattgacggcatgacggttcgcggtcgtgatttgttgagtggtttaccgaagacaatcgaaatttcagcgactgacattgccagtgccattcatgaaaatgttcttgatatcattacagcaattaaagagacgcttgaagaaacttctccagaaattgctgccgatgtcattgatcatgggattgttttaacaggtggcggtgccttattgaagcacttgccggatgtcatttcggatgaaaccaaggtaccggtcttcattgcccaagatccattggattgtgttgccatcggtactggcgagtcattgaagaatattgatgtcctaaagaagcgttaacagcccataaatgaagatggttcgtgtgtggcaagaggctgggatgatttgatcctggccttttttcgcgagtatgacggaggaaccaatgcagaaattcttttccaataaaaaattgatcgccctcatgatcgcgttgctggtcagtcttggtttgatcgcagggtcgatgtatgcgagtaataatcgtaacaccccgccatttattcaacggattgccaacgatgtcgtgggcattggcggtcgcttggttgccattcctggggattttgctcggaatggcttggatgacatcaacaatcttttggatacctttcaggagaatcaacggctaaaaagtcagctggataatttagctcagacgaaggttcaggtgcagacacttaagcgggaaaacaagcagctgaaaactcagttgaagttaaacggcaccttggccgattattctcaaattagtgccgcggtgattttacggacaccaagtgactggcgcaacatggttgtgattaatcaaggcagcgctgctggtgtcaagaaaggtatgccggttatggccggttcgggactgattggtcgagttgttgaagtcaatcggacgaacgccaaggttgagatgttgtcgacggctaacaagtctagtgatcgcatcgctgccgctgttgaaactaaaggcgataaagaagtgaacgggatcattactggttacgacgagaagtccggcgatctcattttgggtgagctgaatactgatactgatattaaaaaaggcgacgatgttgtcaccagcgggttaggcggtatgaccccgaaaggcttactcatcgggaaagttgccagcgtcaaaaaagatgactatggtttggccaacagtgtttacctaacgcctgccgccagtctgaatgatgttactgtggtgactgtcatttcgcgcacgattgcaggtgactaagatgctgaatgaaaaacactttactggtcattggtggattgttctcctgttgttgctgctgatgttgattgatggtagtctggcatcggtattagcccaatggatcatgcgcccgaattttatgggcacgccgcagctgacattacttggactcattatgatcacgttatttgtccctgaggaaaagtatattacttggattgctgcgatcattggactcttgtttgatacgttttatactggcattttaggggtcaatgcactgctgtttccattagtcatttataccattcgacagattcgaccgtatattccgcgaacaccggtgtttgtcggtatggtttatattattgggttattactgtatggcattgcgaactacatcatgaatcgattcatcggtttcggtactggaaatgtcgtgatgcttattgcaaaccacctcggccctggtctgacagtcaacttggcgttgtttgtcattgtatatgggccgttgcaccgtttgttagacaatttagctgaagaatagttggggtgatgatgtggacagtgtcgtcttaaaaggtcgtaacgatggtctggcgctgcagcttcaagatacagcagattttgagcagatcatgcgcacactgaaaacattactaggcaaactttacgaagaaacgccaactggtgatgtcagttaccgacttgaaaccggaaaccgtttgctgaccgaggagcagttagccgatattcaaaagatttttgctgattttccgcgtttttcaattaatggggttgtcagtgcggtgatcgacaaaacggttgttaacgaaatgattgcagccaaaacaacccatcgcatcggcggcgttattcgttctggtcaaaccatcgatttgatgggcgacgtgctttttctcggcgaccttcattctggtgctaccttgtgtgcttctggtaatatctttgtgatgggtcaggttggcggcgtggttcaagccggcagtcaaggagatgctcgtgccgttgttgtcggtgatttgaaaggtgcggggcagattcgaattgctgatgtcgtggagattgtggcagatcattacgatcctgaccgaccagtggcttatttgaatgagttacatacgatgacacatgcgggattagcggatctggccagcattcgaccgcgattattcaagcaaatggaggcaatgtagatgggtactgcgttagttgtcacatcaggaaaaggcggcgtcggcaaaacgacatcgtctgctaatatcgggacagctttggccctgcaaggaaaaagggtcgttttgttggaccttgatattggtttgcgaaatctggacgtcgtgatgggtttgtcaaaccgaatcatctatgacattgtcgatgtggcaaccggtcgcgctaaactacatcaggctttgatcaaggacaaacggtttgatgacttgttgtacttactgccggctgcgcaaaacgcggaaaaagatgctttggagccagaacaggttgttgaaatcgttgaacaattacggcctgattttgactttatcattcttgattcaccagccggtattgaacaagggtttagaaatgcaactggagctgctgatggtgcgattgtggtgacgacaccagaaatttctgctgtcagtgatgcagatcgtgttgttggtttgcttgaacaacgtgaaatgccaataaaaccgcgcttggtcattaatcgcattcgccaaaacatgttagccgatgggcgctccatggatattgatgaaattacgagtcatctgggactcgatctgctcgggattatcgtggacgatgatggtgtgatcgcaagctcgaataagggtgaggcgattgtgatgaatccagacgatcttgccagcaagggttatcgtaacattgctcgccggctgttaggcgacagcgttccattgatggatattcggataaaaaagcagggcttttggtcaaaactgttccatcgtcacgactgaaatacgtgctggcgtgacagcaaatcggtgaaacgtttcagaaactagttgacattgattaagattcggtgtaatttagtgacaattcattaaagcgttgagtggaatcgatgaatggtcgtgtcttgaagcgagtccgggatgatgggaaccggatagacatccattggtcacacatccacgagtggatgattgaacgaagtaggtcgtctcggttgggctcgttatcgccgtggttgagataactacatgaggttagctgtgtgagcagttaacaaatctgaggtggaaccgcggtaaaagccgtcctcttacagcaatttgctgtaggaggacggctttttgtttaccggacatctttcttggacatgatttttcaaccacgtgaggctgattgtgtgaacaatcagcaaactgaggtggtaccacgcaaaagcgtcctcttgcagcagcatgcaagggggcgcttttttgacgagttggcgcgaacagtcccagctatgcgaacgccatcagtcacactgacacagcgctgaaacgaatatcattaggcttgaatacgaaaagggcgtgaactggtgtgattagaaacccgagcgtaagcgaccaaggtccttatcagcaggggttttgcaccagtgaacgcatttagaggaggaaacaccatgagctatatttttcagattttaccggcattattatctggtgtgaaaatgacgttgggtatttttgctatcacactgattgggtccattccgttaggcttgattctatcggttgggttgattccaaagccaaaatcgatactgggtaaagcagggaaagggctgcttgaaggttatgtgtgggttttccgcggcacgccattactgctgcagttaatgtttatcttttacggactcccgattattggattggtatttgatcgattctccgccgcactggtcgccttcattttaaattatgccgcctattttgccgaaattttccgtggcggcttcggggcaattgatgaaggccaattcgaagccagcaccgtcttgaacatgacgcgttggcaggcgctgcggtacgttgtgattcctcaagtggtcaaaattgttttaccgtcaattggtaatgaagtcatcaacttggtgaaggattccagcctggtgtacgtcattggcttgggcgacttgctgcgagcaggtaatatcgccagtgctcgtgatgttaccttggtgccactggtacttgtggggatcatttatctgttgttgacactgatcctgacatttttacaaaaacggatcgaaagtgcattttcatattatcgctaggaggggcaacctatgttagaactcaaacaaattaataaatcatttaatggccagccagtcctggtggatatcaatgtgacgattgaagatggcaaaacgttagccattgttggaccaagcggtgctgggaagacaacattgttgcgaatcattagtggactagaaactgcagattccgggacgatgatctggaacggtcagccaacgacagcgcaagcattacgcaaagaaggcgtcattggcgttgtattccaaaatttcgaactttttccgaacttatccgttatgcgcaacatcacgcttgcaccaaccttgcaaggcgttgatcagaagaaagctgatgaaactgccaagaagttgctagatcggcttgaattagtcgctcaggaaaatgcctatccgtattcattgtcaggcggtcaaaagcagcgggtagctattgctcgggcgttggcactgaatccgcagatcttgctttacgatgaacccaccagtgcgcttgatccgcttttgcgggaaaatgtggctgccttggttaaccaattcaaagcttctggcatgacgcaggttgtcgtcacgcatgacatggactttgccgaaagcgtggctgacacgacttatcacgttggcaaaggcggtgacggtcaatgaaacgccgaatcgtactggcactcatgttactcgtcacattgctaggcaccgtcattagcggatgtgcgcgcgaaaccgtcggcaattcctggccacggatcgaacgaaccaaaaaagtcgtcatcggtttggatgacacctttgttccaatgggattccgtcaaaagaacggtcaactggctggctatgacattgatctggcaaaagcggtattcaaacgctatgggattaatgtcgattttcaaacgattgattggtcaatgaaggaaactgaactgaaaaatcaaacaattgatttgatctggaatggttattcggtgacaccggaacgaaaagagaaggtggctttctctgataattatttgattaatcaccaaattttagtcaccaagaccaaaagtaatatcaaaacgatcaaagatatggctgggaaaaccttgggtgtccaaactgggtcaagtggcgcctttgatctcgatgcccagccaaaattgctgaagaatttcattgcaaacaaaacaccaattctgtatgacacctttaacgatgctttcattgatctcgatgcaggacgcattcaaggaattttaatggatgaagtctacgctcgctattacattgcccacaaaccggacccgtccagctatcgcattgccagcgacgactttccacctgaaaactttgcggttggcatgcgcaagtcagacaatgtcttacgcagcaagattaatgccggtttgaaagcacttaaagctgacggcaccgtagcaaagttgcagaaaaaatggtttggcaaagtcgaggagtaatcagcgtatttgcgaagaaaaaatgaggttgtgccgctggcaattgtcagggcatgaccttttttcgtcaagaggcacctaaaaagggaacttcgggaccacttgggtgagtatggaaatgtattttttaaaggcatagctgggctaattaggttatgatacttaagtaaccttcgccaatgaaaccacttgtaggctcaaaatttgctggcagttacggggaggaaatgttatgtggatctggttggtccttgggtttctttacatcatcaacgcactgacagcgatcatcacggtctttcgttcgcatcgtgatatttctgcagtttgggcatggctattggtgcttttactgttgccggtggtcggcttcttgatctattttgtttttggccgcaagttacgggctaatcgcatgcaggatctgatgacgcagcgtttgctgggcatcgacgatttagttgatcagcagcagcaagccttggcagctggccaaccgttgattggaacgcctggcagtggcggtgtttccgaactggtccgcaccttattgcgtgctgatgacgcgctagtaaccacccacaatgatgtgcaagtcttagcattgcgtgaagccttttttaagcaattgttcgaagatattgctgtggcaacggaacatattcacatcgaagcttatactattcggcctgatgcaattggccaccagttgcgcgatttgttaattgaaaaagcccacgccggtgtcaccgtacgcgtgctttacgatacatttggctcccacgacctaccaaacaatttttggaaaaaattaacggcagctggcggtcaggttgagcggtttgtcgctacgaaactggggcgttggaatccgcgaatcaactttcgtaatcatcgtaagctgatcattattgacggacagcttgcctatctgggcggttttaacctcggcaaggaacaccacggattgccaatgttgcgcgatactcagttacgaattcagggcaaggcggtcgccgtggcccaggcgcgctttttgatggactggaacggaacgagcaagcaacaaaaagtaaaaaatgttgatgtcctgtttagagagccggttgtcactgggaacacgacgatgcaaattgtctctggcggaccagagcagcaggttgaagcaatcaaactaggctatcttggcctcattaatcaggcaaaaagaagtatttggatcgaatcgccatatttcgtcccagatgacagtttgctggatgcgctaaccattgcggcgaatgccggcgtggatgttcgagtgatgattcccaaaaaagccaatcagatcttgatggccaaggcttcgctattttatcttaatcaggttgtggcaaatggtggacaagcatttttatatgaagaaggttttttacatgctaaaacgattgtggttgacggcaaatacgtttcaactggcactgccaacttcgatatccgttcgtttaaactgaactttgaaattgcggcgtttatttacgaccatcggattgggaagactttccaaaagctgttcttagcggacatggaacgggcaatgccttacacgcaaaaagtgatcaaagcaaaaacgcggcctaagcaactcagtgaagaactctcccgcttactagcaccaattctgtaatcgccgcgccatgaagctgagttgaaaaagagcagataaaaagccgctggcacagcggctttaagtataaggtgagatcggtttagatcaattgtaaacttgctagggcacccagaacaacgcctaaaacggtaatgatgatcatgacccaggcgctgatgatggtcatcttctggaacttgctttttttctttttctgcaccgaaaacaccacctttgttgttctgctggctatcattgtactggtttttgccggtatcggcaagataatcgctgctttttgtggtcttttctagcgactaggtcggcgaggcagtattagttgtggtcaagtactgcggcaatatcgggggcttcattctttaaaagcctaatagacgagctaacagggtgttattcaattttttgttaaattttttcaaaaaagcaggcaactttaccacgcaattattttgcaaagcttgacgctccacggagctttggttagggttaattgagagatgtatcaatacgcggcaccgaagacggttgctgcttttggagggaatcatcatggtgttgcttgcgatgggtttgcccattctggtatggctggtcgtcgttgcggctgtcgttcaattcgattttcatggcggttcgtggttttgtttactcgcaatcgttaatttttgggctatttttaaactaacctttaccaagacaccaaattttatttgggtcattttgtttaccacgatggtgattgccttgattttggtcatttggcaggtggtacgtgaatatgacctaatcgttcgtcgatattggcgcatgttgacccgtgttttagccttagccaccacatgttggtggatggcgggtgttttaatcttttttctgggttaattccccacttttctcccacaactcattatcgcccgtgacccttgtgatcacgggcttttttgtgctcttcaaaatgattaacttattaaataacccaattttcattcataagtggttacatgtggagaagagtgggtcattgtggtagactgaaaaaagtagggaggtgtcaaccatgctcatgggtgaatttgaacgcagtattgatgcaaaagggcgtttaattattccagctaagtttcgcgatcagctgggcgcctcttttgtgctcacccgtgggatggatggctgccttttcggttatccgattgctgaatgggacaaactccagaccaaacttgcaactttaccattggcaaaaaaagatgctcgaacctttacccgatttcttttttctgccgcaacggaatgtgatatcgacaagcagggacgaatcaacatcccaaaaccgttgttcaaacatgctggtttgcaaaaagattgcgtactagtcggcgtgaacacgcgtatcgaagtttgggatgccgaacggtgggaacagtttgctgaaaccgctgaagaaaactttgatgatatttctgaaaatctaacggactttgggttatagcgatgacagaatttaaacatgaaacagttctattaaaagaagcgacggcggcattggcggttaaacctgctggtacttacgttgatgcaacgttaggccgcggcggccatactcgacagattctcaatcagctgacaactggtcgattaattgcgtttgatcaagatgaggcggcgattgcaacggtcacagccgattttggaacattgccaaaacaactcactttggtacatagaaattttcgagatttgaccgatgcattaacgacgctgggaataactgaagttgatggcattttatacgatctcggcgtttcgtcaccacaatttgatgattcaaagcgcggcttttcctatcgctttgacgcgccactcgatatgcgcatggaccagcgtcaaacgctcgatgcaaaaacaattgtcaatgaatggccttatgccgatttggttcgcatcttttcccgatatggcgaggaacatttttctaaacaaatcgctcggcgcattgagcaagcacgaacagtccagccgattacaacgaccttccaattggttgagttgattaaagcaggcattccagcaaaggctcggcgaacaggcggtcatccagctaaaaaagtttttcaggcaattcggatcgcggttaatgatgagctatcagcgcttgagtcgtccttagaacaagcgttgaagttgatcaacgtcgggggacgcatcagcgttatcacgttccaatctttagaagatcgactcgtcaaaacgatgtttaaagaagtttcttcggttcaggatgtgccgcgtggcttgccggtcattccggcctctgcacaaccgaattatcgcctagtaaatcgaaaaccgattttaccaagtgaagaggagcttgcggtgaatcaccgcgctcatagtgccaaattgagagtcattgaaaaaattcacgattagggggtacaatctatgcttgagagtacagcaagaccattagtgcagcagccggaaacaccgccaatacataaacctgtcaccacacctgcgcccaacacacatattgcatttagcgggtttgaaaggacattgatgtttgcatgtggtgttttagcgaccgtggtttgtgtagtctgtttgtttatgcaaaatcggttgagcaatacacagcgtcagtatgaagatttgcagacgcagatcgccaaacagtcccagacgactgcgaatctcaagcaggagattggtgaactttcaaattcagaacgccttgatgcctttgccaaagcacacggttttaaggttatcaacggcaacataaagcgtgttgataataaatgaaaattttcaaatcaaaacgatcaacgaatgcacatcctgcccgaaaccgtaaaattttcggcatctggatgatcggggtcacactcctgatccttggtgggttcgttcttcgtttttcttttgtggcgactgttggcgaggttgattctaacaatctggcgaagcagcgacaaaaacaatatcaaactgatactgtcttgcaggctaagcgcggcgccattcttgataaaactggcaatgtgatcgcagaagattccaatacttataccatttttgcgattttggacaagcaaagcaaagacagcaacaataaacctgattatgtggttgataaagcaaaaacggcgaagattcttagccgttatttggcgatgtcagaagcaaaaattttggcgcgactaacgccaggtaaaaatatgtatcaggttgaatttggcacacctggcaccaaattgagtttggcgatcaagaaacaaattgatgctgaaaaactgccgggcatccattttcgtgaaacaccgtcgcgactgtatccaaatggcgtctttgcgagtcacgtgattggtctggctcaggcacaaggcaaaagtaccagcttgacaggcgtcatggggcttgaaaagcaattcaatacggttttagccggtacgaatggttatcgtcgcagccagactgatgcatatggctataagctgcctaacgcaaagacgaatctgaaaacgcctgttaatggcggtaccgtctacacaacgctcgatagtggtttgcaggcctatttagagacgctgatgaccgacgtgcaaaataaatatgaaccaaaaggcatgacggcagtgttgatgagtgctaaaactggacagattttggcagcgactcaacgaccaacgtttgatgcttcaacgggtgaaggcttaggcgacatgtggcgtgactcgcttgttgaagacaattatgaaccaggctcggtcatgaaaattgtgacgctggcggctgcgattcaaagtggcaagtatcacccaaatgattattatcaatccggatctatcaaattggatggtggtactgttaatgactggcgaaccggcggctggggatccattcctttaagcaaagccttccctctgtcgagtaacgtggggatggttaagattgaacaggcaatgggggctggcatctggaagcagtatttggataaattccgtttcggccagaaaactggcatcaccttgccgggtgaaactagcgggcacattagttttgaacggcccctcgaccaagcaatcacctcatttggtcaaggcattgaggtcaatgtgatgcagatgctgcaggcgatcagtgccgtttccaatggcggcaaaatgttgaaaccgcagatcgtttctaaagtcatctctcagaacggcaaaaccaaagtttataaaccggaagtcgttgggcaacccatttcaaaggaaactgcggcccaagtcattgatgcaatgcggcatgttgttaacgatgaagacggcaccggtgtcgcatacaagatgcccggtgttgatctggctgtgaaaaccgggacggggcaaattgccagtccacaaggtggctatctgacaggtgattcaaactataccttcagtgttgccggggttgcgccggcttctgatccacagtacgtcctttatctggccatgaaacaaccgcaaaaaatgacggaaccagccgaatccattttggctagcatttttaaaccgatgatgcagcgggcactggatacaactgctaatggtgcggttactgatgataccaacacggccaccattccagcggtcactaacgcggcattgacaacggctcaagatagcttgaagcaagccaatttcgacgtggcaactgtgggtacaggtaataaagttgtgcaacaattaccaacaagcggtaccaaggcactgcacggttcccgagttttgcttttgacgaacggggccatgaccatgcctgacttaactggttggtcaaaatctgatgtgttaaaatttgtacaactgaccggtaagaaattcaaacttgtcggtgatggttttgtaacccagcaaagtatcgctgcaggcacattgttaggcgatactagcgggaccattaaatttaaacaacaatagaattggggatagtcatgcaacttgctcagatgctcatcccgatggtttcggcatttgcaattaccattatgttcatgccattgttcatcggctacatgcgttacaaaaaagaaggtcaggtgattcgcgaagagggtccaagctggcacgagaagaagtcaggaacaccgactatgggtggtttgatttttattgctgctatcattgtgtcggccatttgggtcggtatttggcagcatcaactgacgctcagtgtctgggtctccttgtttattttggtgctctatggactgcttggcttctatgacgattttgagaaactggttcatcatcgcaatgaaggacttaaggcatggcaaaagctagccggtcagattctgggtgcgattattttcctaatcgcttatttccatgaaggctttgatcacacactatgggtgccaattattggcaatgtcagtgccacttggttctacgttctttttgtcattgtttggttggtaggcttcagtaatgctgttaatttgacggacggcttggatggcttggttgccggtcaaacaacaatttcatttggcacttacgcgattatcgcggcacatgacggtcggactgatgttttgatcgtttgtttggtgacgatcggtgccatgcttggtttcttgatgttcaatcacaaacctgctcagatttttatgggtgatcttggatcattagcgctgggtggcatgttggcagtggttgctatcttgctgcaccgcgaatggtcattgttgttgattgggattatttatgtcaccgaaacagccagcgtgattttgcaggtgggttcttttaagttaaccggcaaaagaatctttctcatgtcacctattcatcatcattttgaaatgaagggctggtctgagtggcaaattgatctgacgttctggttggtcgggctaattggcagtggcatctatttagcattttttctttaaaattaaggcataagcaaagaaggataaatcgtgaagaatatttcggattatcgcaataaaaaagtgcttgttttgggattagcgaaaagtggcgtgaatgcggcacgcctattacataagttgggcgctttagtgacagtcaatgacaaacaacaatttgacgacaacaaagacgctcaggaactgcttgcagacggtatgcgggtcattaccggcaggcatccggttgagctcttagacgagcatttcgagttgatggtcaaaaatcctggcattccatacagtaatccgatggttaagcgggctgaggcgttacatatgccaattatcactgaacccgagttggcttatcaggtttcggaagctcaatggatcgggattactgggacaaacggtaaaacgaccacaaccacgctgattggcttgatgttgaatcagcagcggccacatcatgcgtttgatgcgggcaatattggcattcccgttagtcaagtcgctcaaaaagtcggcaaagacgatacgattgtggctgagttgtcgagttttcaactgtgcggcatcaaaacgttgcatccacatattgccgttctaacgaatatttatgaagctcatctggattggcatggcaaccgggcaaattatgttgcggccaaaatgcgaattaccatgaatcaaacaccagacgactatttcatcatgaactgggatttgccagaaatgcatgagttggcgaaacagagcaaggcacaaatcgtcccgttctcaagaaagaacgcggaaggcgctcgagctcagttaatcgatggttggctgacgtttgatggcgatcggattatgaaggccagcgagatgcagatccccggcttacataatatcgaaaatgcgttagctgccatcgctgccgtgaaactcgaaggggtcggcgacgatgctattcgcgaagtgctgcgaacattctccggggttaaacatcggatccaatatctagaaaccattgatggccgccgggtctacaacgattcaaaagcgactaatgttgaggcagccaccgttgccttgaatgcattcgaccaaccgattgtctggctggcaggtggtttggatcgcggattgccaatggatgcactgacaccactggttaagaaacacgttaaaagcatggttgtttttggtcaaacagcacccttgatggccaagattgctaaagatgccggggtaccagttcaaacgactgagaatgtgatgactgcggtgccacttgcctatgaagtcagtcgccctggtgatgtcatcttactttcgccagcggccgcaagttgggaccaatatcctaattttgaagttcgcggcgatgatttcattaaagctgtcaatcaattaaaagcaacagtcgaaagtggggataagtaaatgcggctggtgatctctggaggcggcactggtggccacatttatccggcactggcgttgattgaagccttaaaagcggaaggaaaacttgacgatgtgctttacgttggcacgaaaaggggcttggaaagtcggattgtaccagcgaccggacttaagtttgcgacgctcgatttgcaaggcttcaagcgaagtctatcgttaagtaatttcacaacagtccggaaatttcttggtagcttgggtgaagcaaaaaaattgctacaggattttcaacctgatattgtggttggtaccggtggctatgtttccggtgccatcttatttgccgcgacacgattgcatattccaactgtgattcatgaatccaattcggtggctggggtgacgaacaagtttctgagtcatttcgttgatcgcgtggccatcgtttttcctgaagttgctaaggcttttccagccaataaagtggtggtgacagggaatccgcgggcccaacaagttgctggtttgaagccaaacgatcggctccgtgatttcggccttgatccgcatattcgtactttgttagcctttggtggttctcgtggggcgccacggattaatgatgcggttgtggcggccttgccaatttgggcgaaagcagattttcaagtgctgtttgccactggccggacgcattacgatcaaattaaggctaaattgcctgatttgccagcgacaatcaaagtggtcccgtacattgatgatatgccatccattttacccgatatcgggttattgatcagtcgggcaggggcgacgactttggcagaaatcacggcgcttgggattccggcagttctgattcccagtcccaatgtgactcatcatcatcaatttttaaatgcccaaagtctaacgaaacaaggggcagcgatcacaattacagaagatgaattagacaatcattttccacgtcgggttgtgaccttgatggaagatgacgaaaaacgtgccgcaatggctaaggcatcaaaaaaattaggtgtcccagatgcaagtgatcaattgatcgcagtgatgacaacgctactttcgaaacgtaggtgataactttggcttggccccgaaaaaagaaaccgcaacctgacccgctgacaccgtggcagcaataccaggcgcgccagcagcagacgccgcgacatgatcggcgccagaagccaaaattgaatgtcgatctgccgaaagtacagaacttacggcggcgtaagctggttagaaacctcacgttgattttgctccccctgctgatattgctgggggtttttggctattttgctagtccgctatccaaggttgggcttgtgagtgtgcaaggtgtgcggaccgtgcctgatcagcaggtgattaatgccacaaaattgtcggatgatgatttgatgttaagcgttatattgcataaaaaagcgatcgctcaacgtgttcaagattctttaccagaaattaaacaagcgagtctgacgtttaccggcttgaatcatattgttatcaaaaccagcgagtatgagacgatcggttacgtctatcagaagcgtacttatcacaagattttgataaccggcaaagtgctgaagaacgggacgcagacgccagttgacacttaccctgttttttcaggcttcacagcgaaggaattgccgcagatgatttccttgctgcagcagtttccgaaggccattcagcgagacatttccgaaattgatgctagtcgtggtgacgcaaatccttaccagatctcgatgaacatgaacgacggttatcgcgtgattgccgattcgcgaacaattgctaacaaaatcaagtattatccggcaattgtttcacaggttaagaaaaaaggtgttatcgatttagaagttggggcattttggcgggcatactcaagtgcggaaaagtcgtcaaacgactgattttgtaaggtttgttttctcaaggcaaatcgagtgtgttacactgataatggcaccattcaattatgaaattaacctattaaacgttacacaaggaggttcccgatacatggataatcaaggtatttacgttggacttgatatcggaaccacctcaataaaagtcattgttgccgaaacagtaaagggacaaatgaatgttattggtgtgggaagtcagcgatcggaaggcgtgagccgcggggtgatcgttgatatcgataaggcagttgccgtcattcgtgcggccgttgcccaagctgaagacaaggcaaatatcaagatcgatcgggtcgttgctggcattcccgccaacatgctgcagattgaacaagtttccgggatgatcgcggtcggtgaagagaataaagaaatttccgacaacgatgttcgcagcgtggcagcggcagcattggtccgcaacttaccaccagagcgtgaaacattatcattagtcccgaccgagtttatcgtagatggttttgatgatattaaagatccgcgtggtatgttgggcgttcggcttgagatgcgtggcatcatgttaactgttcccaagaccgtgattcataacacgaagaaagccattgaaaaggcgggtcttcgagttggcggtttagtgatttcgcctttggccattggtcgtttggccttaaccgatggtgaacaagattttggcaccgttttgattgacatgggtggtggtcaaagcaccgctgccgtgatccatgaccgtaagcttaagtttacgtcggtggatcaagaaggcggcgagtatatcactaaagatatttcagttgtcctcaacacgagttttacggacgctgagaaactcaagcgtgaatatggcaatgctgattcactggcaacgagtgaggaagagacttttcctgtaacggttgttggcaaacacgagccagcgatgatctctgaaaaatacctttctgagatcatcgaggcgcgagtggcgcaaatctttaaacgtctgaacaaagcgttggacgctgtcaatgcgcttgatttacccggcggcattgtgattactggcggcactacggcgttgccaggcgtgacggaattggctcaggacattttcggccgaccggtcaaacggtttattcccgatgatatggggttgcgtcacccatcctttactgaagggcttgcccttatcaaatatgctgcccagatgacagatattgaaatgctggtctccagcgtcttgccgacaccattcatggttgatggcgccgatgtccgtccacaaccacaaagtaagcagccagagcaaccggctgccgctgtggaccaaggcaatcagcgattacttaagcgcaagcaggaaaaacaaccggataaaccaaaatccaaggaaccttcagcattacgccggttctttggcaatttctttgaataaatctcgatcctaggaggaacacgaatggattttcaaatggacgcacaaaatgaaaaaggcgccaacattaaagtaatcggtgtcggcggtgcaggcggcaatgcgattaatcgcatgatcgccgaagatgttaaaggtgttgagttcattgcggcgaacactgatttgcaggctttgaatgccagcaacgctgaaaccaagatccaactcgggcctaaattgacccgcggcctaggtgccggttccaatccggagatcgggcaaaaggctgctgaagaaagcgaagaagccatcggtgctgcgctgcaaggtgcagatatgatttttgttaccgctggtatgggcggtggttctggcacaggagcagcgccgattgttgccaaaattgccaaagaccaaggtgccttgactgtcggcgtggttacccgtccctttacttttgaaggccctaagcgcgcaaagaatgcgacagagggcattgcacaactgaaagagcatgtggataccttggtgattattgccaacaaccgtctacttgaaattgtcgacaagaagacgccgatgcttgaagcgttccatgctgctgataatgtgttacgccaaggtgttcaaggtatttccgatctgatcaccagccctggttacgttaacttggactttgccgatgtgaaaacagtcatggctaaccaaggatctgctttgatggggattgggagtgctacgggtgaaaaccgtaccgttgaagcgactaagaaagccatctcaagtccactgcttgaagtaaatattagcggtgccaaacaggtactgttaaacatcactggcggcccagatttgagcttgttcgaagctcaagatgcttcccagattgtggccgactcggctaaagatgatgttaatatcatcttcgggacatccatcaacgaggaacttggcgatgaagtcgtcgtgacggtgattgcgacagggatcgaagaagatccccgtcaggaaccttcacgtcgcaacgttgctaagaaccgcacaacggatcaagataatcaaggcggcggttatcgcccagcctatgctgatagtgacgccaacgagaatcggcaggcaaaaagcgatgatccttttggcaactgggacttgcggcgtgaaccaagcaagcgtcaggcaccaagcggcgatgatataagcaacgctaagaaaaaagatttcgacatttttgaaaatcaaactaacgcagacgatgctggcggcgatgatcagccaccattcttcaagcgtcggcgtcaatagtcaggaggtcatgatacatggcgtttgaaaagttaggcgaaaaatttagcaacttctttgccatggacaatgaagatgattatcaagaccaagaagacgaacaggcgcaacaacccgcaccagaacaaccggtggacaatcattatcgcagcaacaaggtggtttcaatggcaacgcccgctggtaagacagcgaagatcgtggtttatgaaccgcgagtgtactctgatgccaaagaaatcgggtcgcatttattgaacaatcgggcggttgtcattaactttgatcgcatcggctccgatgatgcgacgcgcattgtcgattttttgacaggcactgtgttcgccattaatggtgagattaaacgggtgggcgagtcgattttcctcgtgacccctgctaactttgaaattgatgggtcactcgccagcaccattgactctgacggtttgaacctttcttcgccacattaacgaggtgtcaagtgttcaatttactcaatgcaatctatcaggtgggcagttgggcaatttacctttatatcatcatggtcttcatttacattttgatatcttggtttcccaatgctcaaggctcagcactggatcgctttttaagcagatttgttgatccgtttctgagcatctttcagcgattcatcccaccattggctgggattgatttttcaccaatcctagcattctttgtactttcacttattaaaatggcttggacgaaattatttatcatgttagtccagaagcttgtaatcgggtgacaacttatggatgccatctatcagcattttcgaaaagatgaagcggcactgatcgaccattttgcggaactaattgaaaccgcacgaacggagtaccggccagtgctgacagactttacagatccacgtcaacggttgattgcgaccagtttagtaagcgccgatgacgatattaagctcgtacattttggcgggtatccccacgctgagcggcaacgaatcatctttgcaccgagctatttctcagcaacggcggctgattttgatattcggttgttacagatcatttatccggagaaattcgccgaactgcaccatagtacagtgcaaggcaccctattgaacgcaggccttgatcgtgatgttttcggtgacattatcacggatggtgacatttggcagttctttgtggccgcacacatgcaggattgggtcacaagcaatgttgataaaatcgggcgcgtaggtgttcatttcactgaacatccgctggcggattatgtgacaccggaaaatgactgggagccgctcaatttttcagtcagtgctttacgcttggatacagttgtggcccacggctttaacatctcgcgtcaacgtgccaaaaccttaattcaaggcggtaaggtgcgtcttaactttggtgaatcggatgcaccggatgctgaaattgcaacatcagatattatctctgttcgagggtttggccgcttgcggcttgatgagattcttggagagagtaaaaaaggtaaactaagggtctcagcggccgtgattcataagtagtcacaccgccgagtgcaacaattgtcccagaaaacgaattgatgaggaggactatcaatggctttgagtccactagacattcacaataaagaatttagcagcaaaatgcgcggctatgataaggacgaggtcaatgacttccttgcccagatcgttaaagattatagtagcttgatcaaggacaacgagggcctgaaaaaagaattggcagatgccaaggaaaaggttcagtacttcacggatatgaaggaagccttgaatcaatcgattatcgtcgctcaggaaagtgctgaaaaggttaaaaatagcgcgcatcaggaagctgatttgattaagcagcaggcgcagcaggatggtcaggctattttgagcaaggccaaagcagatgctgaccagaagttgcatcaagctcaagctcaaacggaacaaaccttgcatgatgccgcattgaaacgtcagaatatttctgtccaaactgaagacctcaagcgacaaagccgggtcttccgccaacgtctgcaagtgatgttggagtcacagcttgaagttgtgaagagtccagagtggaaggaattgctttccagttcacctgaagctgccgatacgaccgatccgagtcaagattcgcttgacaatgcccacgagggtttcgtaaactcagagggagcagtttccggcgctgatggtacctatactgagatcattttcccagatgatcaaagtggcgcaccagcctcgcaagcagcagcagatacaccggctagttcggcggcggctgagtcagaatcgaccaatgacagtaccaatgattctgagtctgcaaccgatcatgatgctcaataacgtatgaacacgcgtcgtttggtggttccctttgcagcgagtcaggaagtaggtgtgagcctgacaagtaccgctgaacgatatcagttcacagttgtcctgccgaagttggtaagcgggaccggttgatcaccgttagtcaatcactgagggggacttgttccctgaagttaggtggtaccacgtttgctcgtcctaatattagggcgggcttttttgatttcaattaataaaggagcgggtcacgtgaaaattaaagataccttgaacatgggtaaaaccagtttcccaatgcgcgctggtttaccgaagaatgaaccgatttggcagaaaaagtgggatgaggaccacgtctatgagcaacgccaaaaattaaatgaaggcaagccaacgtttatgctacatgatggcccgccatttgcgaatggcaatattcatatgggtcacgccttgaataagatcagtaaagatattattgttcgctacaaatccatgaatggcttccgggcgccttacgttcctggttgggatactcacgggttgccgattgaacagcaactagcgaaacaaggtgtgaagcgcaaggaaatgtcgatgaccgattatcgtgaactttgtcggcagtttgccatgcaggaaatcgacaaacagcgcactgacttcaaacgcctaggcgtgatgggtgactgggaacatccttacattacgctgcagcatcattatgaagccagtgaaattcgggtttttggtgccatggcgaaaaagggctacatctatcatggcttgaagccggtttactggtcatggtcatctgaatcgactctggcggaagccgagattgaatatcacgatgataaatcaccatccatttacgtcgcctttaaagtggtggatggcaagggcttacttgacactgatacctatctggtcatctggaccaccacaccttggaccattccggctaactatgggattacggttaatccgcggttcgattacgttcaggttcaagttggcgacaaaaagtacgtggttgctgccgaattacttgatcgcgtcgctgaagaaattggctgggaaaatccgaagatcctgaaaacctttaagggcacggatatggataaaatgactgctcagcatcctttatatgatcgcacgagtcttgtcatgaatgctgatcatgtcacgttggatgctgggactggacttgtccatacagcgcctggtcatggggaagatgactacaaagtcggggttaaatacggcttgcctgtcgtctcagtggttgatgccaaaggttacatgaatgaatatgcgcccggttttgaaggtgtcttttatgatgatgccaacaagcagatcacccaagcactggctgataaaggcgccctgctgaagcttgatttcttcacccatagctatccgcatgactggcggacaaagaagccggttattttccgggcaacgacacaatggtttgcgtcaattgatgctttccgtgatcagattctaaaggctattgatacggttgactttaagccgagctggggcaagacacggctgtacaatatgattcgtgatcgcggcgattgggttatttcccgtcagcgcgcatggggcgtgccgttgccgatcttctatgctgaagatggcgaaccgattattgaagaagagacaatcaatcatgttgctgatttgttcggaaaatatggctcaaatgtgtggtttgagcgagaggcgaaagacttgttgccagaaggctatacgaatccgcatagcccgaatggtcaattcaccaaagaaaaagacatcatggatgtgtggttcgattccggttcctctcatcaggctgttttggcggctcgtccagagctcagtttcccagctgatttgtatttggaagggtctgatcagtatcgcggctggtttaattccagtctgatcacaagcgttgctgccactggtgtcgcaccttatcgcggtattttgtcgcaaggtttcaccttggacggcaaaggacgcaagatgagtaagagcctaggtaacacgattgtcccggccacgattgaaaagcagtttggggctgaaatcatccggctgtgggtcgcaacggttgactcttcctctgatgtgcgagtttctgtagacaactttgcccaaacttctgaagcttatcgaaagattcgaaatacgatgcggtttatggtggctaacacaggcgacttcgatcctgaaaaagatacggttgcttataatgaacttggatcagttgatcgttacatgatggttcgcttaaaccaaatcatcaagcaagtcaaaacagcttatgatgcgtatgattttgcgaccgtcgaaaagactatcagcagtttccttgtcaatgatctgagtgctttctatttggacgtcgctaaagatgttgtgtacatcgaggcgaaagatgatcctaagcggcgtggtatgcaaaccgtgatgtttgccgccttattggccctcactaagttgatcacgccgattctgccgcatacagcagaagaagtttggccatatctcaagcagccagaagcctatgctgctttggctgatatgccagaagcagaacagtttgatgatgaaagccaattgttagatatctggtcaggctttatggacttccgttctgaagtgcaaaaggctttggaacttgctcgtgacaacaaagttatcgggaagtcgcttgaagctgcagtcacagtttatccttctgaacctgttcgcgatatgctggatgacgtcgatgccaatgtgatgcagcttttgatcacaagtcacttcgaaattgcgcctgcaactacaaaggcaccggccgatgccgaacagtttgatgacatggctgttgttgtaaaacatgctgacggcgaagtttgcccacgctgccgaatggtgcgtacagatattggtacagatccaaagttgccgcaattgtgcagccgatgtgcagctatcgttgaggctaatttcccagatgctgtcactaacgggtttgataagtaggcgggtgaagacatgcaaggacgcgttaaaaactttaacgttgacaaaggctatggctttattgaagctgaggggcaaccggatatattcgttcacttttcggcgattaatgaaccgggatttaaaagtctgacgcccggtgaaacggttgatttcgttattgttgaagggcctcggggtccacaagcagcgaatgtgacggttcatcggtctgaggatggtgctccgcaatagactttttgacgccccgttgtcggctggcgatagggcgcttacgtaaatcctagacagtaaaaaacaccgcgagatcaaatcgcggtgtttttgtatacagcattcagtttttgtggtgcaagtttttagacttaaattacttgttgatttcttcgatcttaccgtcatgcgtacgggcaacggtcatctgagtaacggggatgtaaccgagctttggtaccaatgtcttttggacattctttgactgaatataattgatgaaagctgctgtggaggcgtttggtttgcctttggtgtacatatgttcataggcccaaatcttccaagtgttggtggtcacattcttgtccgttggttggacatgattaagggcaagcttttgaacaccgtctttaattgctgagaaggcgagatagctgatggcacccggtgttgttgaaaccatctgataaacagtaccgctagaatcttgttcctgactggttttaactttatttgtcttgatcccgaactgttcgaacgttgctcgtgtcccggaaccttgtgcgcggttaatcaatacgatggcctgatctttaccaccaacttctttccagttagtgatcttgccttggaaaatatcaactaattgctgcgtggagatgtttttgacgccggcgtccttgttgacaactggcgcaatcgcaacaacggctacctgatggtcaaccagatcatcagctttcaaatcagatttttcttgggcaaaaatgtctgaattaccgattgtaactgaaccggctgcaacttgactcaaaccggcgcctgaaccaccaccttgcacggtgatttctgccttaggattgtctgtttgatattgcttagctgcctgttcaaccaaaggctgtaaagctgttgaaccaactgccaaaatcttgctctgcttgattggggcagagctggatttgcttgaactgctggcggatttggacccgcagcctgccaatactaaggtggcggctaaggccacggtcaaaccgacgaacaatttcgaatgcttcattacttttccctccaatacttgaataacctaagcataaggttgctgtgtaaagacttcgccacgttgctgtaaagaatacgttttacttttgtaaaggctgtaacggttcctttgaaatgccgacaacactcggcgtataatgacgcagataggctttattaaaggagcggaacacgtgaaaaattacattgaggacaaaaatgttcagaaaaatcggtggtggatcctaactgccatcggaatgtttacaattatgtcgacgctagatgggtcaattgtcaacattgctttaccagtgatgagtcgcgatttacatattccaatgaatcaagcggagtgggtggtttcgatttatctgatgatgatctgtggtttgttgctgttttttggccggctaggtgattcaattggcaaaatcaaagtttttcgagttgggatggtgctattcttaattggttcgctttttgccggtttcaacaatagtcttgccttgttgcttgctgcgcgaattgttcaagctactggtgcatctatgaccatggcgaacaataatgggatcgtaacggagatttttccaatgaatgagcgcggtcgcgccttgggtctgatcggttcctttgtgtcgattggtgcaattgctggtcctgggattggtggtttgattttaggccagttgccttgggggtatattttttggatcaatattccgattgggattgtcgctttgatcctcggaacgattgttttgccaaaagatctacccagcaggcgcgtgccgattgattgggctggttttgtgacgtttctagtcttgatcttgtccctttttatggggatctttttgggacaggaacgcggctttaccgatcccctcattcttgggctgtttgcattagctatcgtggcgttcgctgcctttgttcatattgaaaatcataaaaccgatccattggtcagcttcaagatttttcaaaacagtgcgtttaccctgagtttgttgtctgcgttttttattttcgtcacgaactttttcttcaacgtcatttcgccgttttatcttcagaatgcgcggggattatcaccagaaaaagctggttacttattgatgatttttccgattgtgcaagtgattgtggctccggtggcgggtagcattgctgatcgcatcggtccttatcgcatcacaatggtagggttattgatcattgttgccagtcagattgggtatgctttcttcaatttgcagacatcgtttatgtttgttgcgttgatgatcggcttagttggatttggcaatgggctgtttcaagcaccaaataatactgtggtgatgtcgagtgtgccgacccgtgatttaggaattgctggcggtatgaatgcgttggcgcgtaatttaggaatggtcgtcggcatctcaacggccaccacagtgctgttttcttccatgagtcatactgctgggaaaaaagtaaccacttatctgactgggcaaccggacattttcatttctggtatgcatgtttctttttgggttgcaacggggttgtgcatactagcggtgattttaaccggctatcgcatgtggcaggtacgtcatgagacagctgtctaagtgaaagacataaaaaaagcatccctgctttttagcttcattgcggggatgcttttttaattggcgaagtgtttttatagcagacaactgactgatcagttgtctggtgtgacgtctttggggccttgatgactcatatcaccgtgcgtataatttagcagttgttccttcagttcgccttccatttgaaccagttgcttttcggcattttggcgtttaacccgaccgtcttgttgaatctgcaaggtctgtttcaaagtgtcaatcaagtcgttttgtgtttgcgttaacgtctcaatatcgacaacaccgcgttcattttccttcgcagtttcaatcgaactgatcttcaacatgtcactgttcttctttaacaggtcattggtggtttgcgagacttgtcgctgggccgtgacagcatctttttgccgcaacaaggtgagggcgatggccacttgatttttccacagtgggatcgctgtgttgatgctggcttgaattttttcggccaaagcctgattcgtgttttgaatcaggcgaatctggggtgcttgttgaatggtaatttgtcgagccaattgcagatcgtaagcacgtttatccaaacgtgacgcgaattgtttcagatcattgacttgctgaattgccatttggtcattggctgcttcggctgctttcaccgcttcgggaatggttttgtcattgagttcacgcaacttaagattggccgcttcaatataaatattcagagcatcaaaataagctttgttttgatcatataattcgtctaacagcttgttatcattgagtaacccgcgttgtgatgtttcaaggcgattggcaatcgtatcaatttgagcaccgatcttttgatacttcgcagtgatttcatagattgatcgcttgacacggccaaataatttgcggaaaatattattattttcagcttttaattcgtctgggttagcctcgttcaatctcgtcatgagacttgtcaaggcatcaccgactgcgccggtatcctgactttgaactttagttaacatgttttgtgaaaagacgccaagttgtttttgggcatcagcgccataattcaaaacagtttcgcctttcgtcacatcgattttgctggctaattcttgtgcttttgcttcttgttcagcacttagttttggcctcgctgtggccgctgcttgaacagcctcagccgaattattgttggtcattgaagcttctgacgtgctgaaaggatcggccaataaatcatctgtcagattggtttgtttgtcatcattcacattattcactccgtttcatgcgccttatctggatcaaggtgttttttggcaagacgaacatcgctatcgagatcatcaagatcatctttaatgaaggcttgatagtctgacttgattttgcctgccatagaagtcatggtcgaaaatgctttgtctaaggtttcgtacgtatctgccgtctttacctcgtgatgcgtaatctgggcatatttttgcatcagatccagtaaattaggtacctgctgataaacgaacgtgccggcatcggttaagcgttgtggtgcttgaacaagtgcctcaaaataggcatgcagcaggtcaaccaaatcggtatttaatgtgagcgcacgcaactttggtacttcttttgtgagtgcctcgatagttcgaatttgttcggcaagatcggccattgtttttctaaaaagtttgatttcctcatcacttaaaccggatgcagcataatgttcagccatcttcggatcaagtgacgggagactggttgattttggcttaggccggcttagttcaccgatatagcgggcgaaggcaaagaccacaccaatggacaaggcgatcacccaacgtccggacagtgcacctattgccgcacccatggcggcccagagtataattcgccatatgcgaatacgtttgcttgtggccacgagatcacttcctctttcgtttgcatttagtgtagcacaaccccgcggcttgactatcagccggaagttggatattagtaattattttattaaggatgcacggttgtaggttggctggtgtaagctgataattaggattgtttggccattttgaagcgttagaggcgagcatggactcgcgcggttagaaaccagcacttaaccgggtttaggcggtgatgaccatttttttgtcatgatggccggggtccttatgtgaagatttctgcgcctacgaatgcagttaaggaggaaaaatcaagtggacgaagaaccgatcgctcagcaacgcgtttttactgggcaattaattgctgtggatgaactcacagttaagttgccaaacaacacaaccgcacagcgagaaattgtacgcgcccaaccggctgctggtgttttggccttaaaagacgacaaggcgctgtttgtcagccagtttcgatcaacaatcggtcagatgacattagagattccagcaggtaaaatcaatcaaggagaagcaccgctcacagctgcacgccgggaattaaatgaagaaaccggcatgacggcgatgaagtggcaacctttggcgagttactttcagtcactaggtttttctgatgcgaccatggcgttgtttctggccagcgagctgcatttggcaaccaatcaattgcagcaggatccggatgagttcgtcaaaggcgaatggttgacactgccagaagcttggcgagcagtcgatgacggtcgcatctgcgatagcaaaaccttgctggctttactttattggcagcagcaaggaataggagcgtgaaccggcttggtatataagaggtcgtaagtgtgatggtcattttttgacgagtgcaatgatgatccttatccacaggcttctggcttggcaaacgcgttaaaggagggcaacatggcggaagttaacacgcgcaaagcatatcgtgaggcacaggaaaaagaacaacacgcggcgcgcgcccgcgaggccaaacgagttgaagttgaaaaagactatgctcgcaaatccaaaggcaaacccgaaatcaggaatgcccgttttgacgaagtgaccttcaggaaggtcaacagtctcaaaaaaagattgaattgggccatcgggattgtctttggcttgttggtgattgtttttctggtactctattttgggtaagctagctattcttggcacttaccagaaatggttactgtagcacaagcgcagtggaagaaagttgattcactcatattatagaagaaagaacggagcgatattttgataaaagtcggcgttatttgtgccatggaagaagaaatcaggaccttactggccaaacagactcagcaacatgaaacggtgattgccagtcaacattattttgagggccaaattgacgggattgatgtgattttggttcagtctggtattggcaaggttcaagcggccatgacggcggctttgttgttgggaacttttaaaccggatgttgtgattaacaccggaagtgccggtggtattggtcaaggtctggcgatcggtgatgttgttatttcgagcggggttgcgtatcatgatgtggatgcaacggcttttggttacttaccagggcagttgccgcaacagccgcaaatttttgaagccggtttagactatgtggctaaaattcaggcggcagccagcacaaccggtttaacgtcaaaggttggcctcattgtcaccggcgacaagtttgttaacggtcaggatgcgattgcggcaattctgaaaatctatccgcaggcgttagcaagcgaaatggaaggggcggctatcggtcaggtggccgaagagttccataccccgtttgttgtcatccgggcaatgagcgatgtcgctgacgagcagtccggagtggattttgacaaatttgtgatcaaggcgggcgaacaaagtgccgcgatgcttcttagcttttttgctcacctacaggcatcacctcagtcttaggagttgattgttaatatgcaacatgtttatcttgataacgcggcgaccacacccatggccccagaagtgattcagaccatgatggaccaaatggagcacgattttggtaatgccagttcgactcattggtttggccgaacagctcatactgtcatggacaagagtcgcaaagttttggctgatgcaatccatgcgcagcccgggaatatggtgatcaccagcggcgcaacagaaagtaacaatacggcgatcactcaaacggcgcatacgcgcgctagtttggggaagcacatcattacaacggctattgaacatccctccgttttgcagccgctaaaagccttagaaaaggaaggctttcgggtgacctatctgccagtcgacgaaaatggccgaatcagtttagctgattttgacgcggctttggacgatgacactatcttagtgaccatcatgatgggcaataatgaggttggcagtcggatgccaatcagtgaaattggtgcgcgactagtcgatcatcaagcttggtttcatacagatgcaacccaggcttttggcttactagacatcgatgttcaagcgcaacacattgatatgttaagtgtttcggcgcacaaaattaacggacccaaaggcatcggttttctttaccgcgatcctaaggttcagttcccgtctttgttgaaaggtggcgagcaggagttgaaacgtcgtgctggtacagaaaacattgctggcattgccgggtttgcaacggcggttagtctgatcacgtctgatgagaaggctaagcgacagtcaaagtatcttggttttaagcagcagattatgggtgcattggatgatgcggagattccctatgcagttaatggtgatattcggccagataatgtcaatcacgttttcaatatctggttgaaggggatctcaacatacgctttgcaaaccaaccttgatttggctggcattgcagtttctggtggttctgcctgcacagctggttcacttgagccttcacacgttttaactgccatgtttggcgctgatagcccgcggcttggcgagtcgattcgtttgtcatttggcgcgcagacaaccaaagcagatattcaggcctttattgatgccctgttaccaatcgtgcaacggcttcaggcaaaacaatcggcgcgataagtctggtttgcgagtgacccgttaccatgcgtttcaacggttaaaaagctcaaaattgtctttcaccacctaataatccttatcaacctccccagtgttgcgaccaatatgctaaacttataaacagttaagcgtgttcctcgcatgcgctgaaataaaaacagtttcaccaccttttgctggtgaaactgtttaggggaggtttttgtatggcactagcagcaaccggatccgcacaaggcgatccgaaaacctatcaaatcgggtcagcgttgaaacgatttaccttgatagatttaggctttgttcaaactaagaacggcaattttcaactgcaacgctcgcttgatccaaattcaccgtacacaacggcaaacaagctgaaaatgacggtggcaaagaatttagataagttccagctcgatgtcacaacgggcaatggtcttaaagcgattaacattttcaaaaccgatgccacaaaagaaaatgtcgagcaatatcaatattggatcaataatttgattgagcgcggtgtgattgaagcaaaataggatgtatgccgcgctttaacattaagctgccacgatgttggcctcagggaggctgacagcttagcagcttttttgctttcttttgattagatcaaaccttacgaagcgatcgtattcacagtaaaaatgtcaatccgtagcaaattggtttttatgattatcagaaacgctaaagtgataagctgaaattaacgaagagaagaaatggagggataatatgtttgaccacggcttcattgaggtccacgatgctaaccaaaataacttgcaacacgtcaacgtaaagattcctaaggatgcgattagtgttttcgtcggccgatcaggttcaggcaagtcttctttagtttttgataccattgccgctgagtcccgccgcgaactgaatgagacttttccgagttttacccaacagtatctacctaaatatggtcagccggatgtcggccaaatcgaccatttaccagtggcaattgttgtcgagcagaagcgtattggtaaaaatgcgcggtcaacgcttgccacctatacgggtatttattccttgttgcggttgttgttttcacgagctggcaagccgtttattggctattcggacactttttcttttaacctgccacagggaatgtgcaagacatgtcagggactcgggtatgtggatgacattgatgttaaaaagttaattgacccgaacaaatcgttgaatcagggcgcgattacgtttgtcagttttggaccagacacgtggcggtggaaacgctacgcttacagtggtttatttgataatgacaaacgattgggcgactatacaaagcaggaaatggacaccttattgtatgccccgcagcaaacactagatcatgcgccaacaaagtggcctaaaacagctttgtacgaaggcgttgtgccgcgaatcaggcggtccattattggtaagaaagaggctgaacatcataagacggcgttggcagaaattgtcacccgtatgccatgtccaacctgccatggaacacgtttgcggccagaggttttgacttgtctcatcaatcaaacgaatattgctcaagtgctgcaaatggatctcgtcaaggttcgccattttctgaatggcattcaagaaccacttgttcaggacgtgatccgtgagctgttacgaaaaatcgattctttgattgacattgggttaggctacctatcccttgatcgaccgactgagacattgtcgggcggcgaaacccagcgcattaaaattgctaaatttttgactagtgccttagtcgatatggtttacattttggatgagcccagtgttggcttgcatccgcatgatattgaattaatcaagcgtgccattttgcgtttgaaggagaaaggcaacactattttaatcgttgaacacaatccggcactgattgcgattggcgataacattgtcgaagtgggtcctggagcggggacaacgggcgggcatatcacctttacaggtacctaccaagcccttttagacagtgacactttgacaggaaaactgttgaaacagccattgacttttcgccagccgcggccagccacatcaacgatttcattgcagcatattcatcgacataatttaaaagatgttagtgtcgcagtaccgctgggcattgaaactgtgatttccggggtcgctggttccgggaagagtacgttggtatctgctttacgtgatcagttaaccgcaccatatattgatttggcacaagccgatatcggtgctaatatccgctcaacgcctgccacatatctctcaatcctcgatccgattcgcaaagtctttgctgacgcgaatcatgtggctagtagttggtttagttacaacggtcgcggcgcttgcccacgttgtaagggtaaaggcgtgaccattaccaatatggcgttcatggatccggttgtacagacttgtgaacaatgtcatggacgacgttacaatgatcaggcgctgagctacacttatcatgataaaaatatctctgacgtgctgcgcatgccgattacaaaagcacaaaacttttttgcggatgtaccagctattgccgcaccattgcgaaatatggcgcgggttggcctcgactatctaacacttgggcaaccattgaccacactttccggtggcgaaaagcagcgtttaaagttggctgtcgaattgaaccgcaccggtaccttgtacttgcttgatgagccaaccgctggcctacatttgcaagatgtgaaaaagttgatccagctatttgacgaacttgtcgcagatggcaactcgttgatcatcgttgaacacaacttagaggtcattagtcaggcagactggctcattgacatgggtccagacgctggcatctatggtggtcaagtccgctatacggggacacctgaaaatagcatgactgtcaaacaatcacgaacgggccaagccatgaaacaatacaatcaggcgccggaacggcaacaaaataataggcattgacgccaaacctgatttatttgtattgaccgttctgcgtcacgttgcactgaaacaagaatgagctggtgacttgttgtttgcttggatcatcagagaaaaactaaattagcatagaccagaaaatgttggtttgcagttccgcgtaagcagccgtcagcctaaatagccaaagcttagctatttggactggcggctgtttatgtctagatcgctattggcaagcttgttatttttgactgaaacgcgttcgcaggcgcagaaacctgcacagaaggacctcaagccaaatggccaaagaccagccatttaggcttgaggccacttatgctccggtttctaaccgcgcctgctcacgctcttgcagttgctatctcatcattcactgttataatggtttttactggaattcgaccttcaaatcggatatctccagaatctgatgaaatgatggtgattgttttggacaattccaacatccgtgttgttgtcggcatgtccggcggcgtggactcgagtgtcacggccctgttgctgaaacaacaaggttatgatgtcgtcggggtctttatgaagaactgggacgacacagacgaaaatggcgtctgtacagcaacaacggactatgaggacgtcgccaaggttgctagtgaaatcggcatcccatattactcgattaactttgagaaggaatattgggatcgggtttttcaatacttcctcgatgagtacaaggctggccgcacaccaaaccctgacgtgatgtgcaataaggagatcaaatttaaggctttcttggactacgctgatcagctcaacgcggattatattgcgatgggtcactatgcgcaggttaagacagacgaaaacgggatcgtgcacatgcttcgcggcgctgatggcaataaggatcaaacgtactttttgagccagctttcacaggatcagcttaagaagtcgcttttcccaattggtcatttgcagaaacccgaggttcgtaaaatcgccgaggcagcgggactggcaacggcaaagaagaaggactcgactggtatttgctttatcggcgagcgcaatttcaagcagtttttgagcacgtatctgccagctcagccgggcaaaatgatgacggtggatggtgtcgagatgggtacccacgatggcttgatgtattacacaatcggtcaacgccaaggcctcggcataggcggtaactcagataattctgagccatggtttgtggtaggcaaagatttagacaagaacatcttgtatgtcggccaagggtttgacaacccagccttgatggccaccagtttgagcgcttctaaccttaactggacgactggtcaggcaccgacagaaggcacccacatgacggccaagttccgttatcgtcaacgggatactggcgtgacgcttcattatcatgatgatggcaccgccaccgttgactttgacgtgccagtccgcgcaatcacaccgggtcaggcggttgtcttttatgacggcgacgagtgcttgggtggcggaaccatagatgctgcatacgcacacacgaatgagttacagtacgtttaattaaactgagtgcaaaaagaaagtcggcgattatgtcggcttttttacatagcggcggctgattgctgcttgaaacgcgttcgcaggcgcaaaaacctgcacataaggaccttgatcgcaatggccaaacccgggccatcacgttcaaggccgcttatgctccggtttctaaccgcgcttgctcacgctcttgtctgaaaacgcgttcgcaggcgcagaaacctgcacataaggaccttgatcgcaatggccaaacccgggccatcacgttcaaggccgcttatgctccgtctaaccgcgcttgctcacgctcttgtctgaaacgcgttcgcaggcgcagaaacctgcacataagaaccttgatcgcaatggccaaacccgggccatcacgttcaaggccgcttatgctccggtttctaaccgcgcctgctcacgctctgcttgaaacgcgatcaccaccccagaaacctgcgtgtaaggaccttgaccgcaatggccaaacccgggccatcacgttcaaggccacttacactccggtttctaaccggggtggctcacgctctgcttgaaattttccttcaaaatctcgataatgaaagagttaagatgcgaaaggatagtacggtcattgattgggacttttgaatcattggccgtgactaaaggggattgacttgtgacgaagttgtattttgtacgtcatggcaaaacagaatggaataatcaaggacgttatcaaggagctaatggggactcgccgttattgccggagagttatgcgcaaattaaggcgttggccggttatttgcaaggaattccttttatgcatgcttatgtcagtccattaaagcgtgcacgaacaactgcccaaaccttgattaaagatttggatgagtcaattccgttgaccattatgccagctttgcgggagttcaatctcggtaaaatggaagggatgacgtttactgatgtaggtaagcattttcctcaggagctgcatgcctttcgtcatgaaccggcagcctatgatccacgaaaaatacatggggaatctttttcacaactgattaatcgggctattccggcgatcgtggcgactgtggccatggatcgcactggtgaggctaatttgctgtacgtcagccacggggccgcactcgctgcggtgattcaaagtctgttgggcacaccactggcggatattcgcaaagacggaggtttgaccaatagcagtgtgaccattttgcacgcagatggaccgaccttgccgtttaccttgctggattggaatgaaaccagtttcttaccggaaccgccaaaagcaacggatacgatttgagttgctacggctgtcaacaacgagataagagggtcaaatggattcaaaaattttaaccatgttcaaccaaggcaagcatgaggaggcgattcaagcggcagtcaaagccattgatgctgcccctgatgatccgaaacgctatgcgatgttggcaacaatgctgattagtatcaaagcgctggatcaggccggcgaattgctggccaaagcgcgccagctttttccagaggatctggaattgcaatacaccgctggcttgtttgcgtatgctcaagcggactttgcggctgcagtttcatggtttgccaaggttagaaccgaccagactttgaaaaatgatgctacctacatgttggctttaagctaccaacaagctggccagccaacgaaggcattggcgtttgcattaacggcgcatgacttggcgccaaagcagctcgatgccgcccttttagcagctgatttgctgatggcaaacgatgtgtttgacgcagcagcccgagtgttgaaaccattgttggcaaccgaacagccacaggttctgttcacgtacggcatagcactgagcgccgctggtaaagatggcagtcattatttgaacaaggccaaggcactcgatccaaaagggtatgatcaaaaagctaacattgtcgctgatatcaaccgattcttgcgattgcaggagggtcaagatggacacgcgtgaggagactgtcaccggtcgggtcaaaagtatctttttccagaatccaacaaatttttttaaaattcttctgatcgaaatctctgcgacgactatcacctggacagagtcagatattgtggtgacaggaacgtttggtgatattaaggaagatgcgacctacacgttcactgggcatgtcgtggatcatcctaagtatgggcagcagtttcaagcagacaattaccatgcggatcagccgacgaataaaagtgggctggtcgattatttgagctcagataagttcccggggatcggtccgaaaacggcaacgaaaattatcgatcatttgggtatggatgctattgacaagattctggatgatccgaaggttttggcaggcttaggcatgacagctgccaagcgtgatatgttggcgacgaatctgaaatcgaaccaaggcatggaacgggttattattggtcttaacgattacggttttactagcaatatggcaggtcgtatttaccaacaatatcaaaatgacgccttagatgtgattaagcacaatccgtatcaattgattaacgatattgatggtatcggctttactcgggctgatcagattgcggcaaaattggcgattgcaccgacttcgcagcttcgtcttggcggtgcagtgatggataccctgcagcggttgactgatggcgaaggtgatacctatgtgacgctgaagtcattggtcactcagacacttgatttattggaacgcgcgagaaacgttgccgtttcgccagacgcagtaggacaggcaattgtgacgctggctaaagacaatgccctgattgcagaaggcgaccgcattttcccgaaacgattatatgatgctgaatggcagattggtcggcaactaaaaggactggcagaggcagacgcaacggctactgaacctgaattggctgagattgaaaaaacgttagcggcggtcgaggcggataccggtattgcgtatgatgcgacgcaaagaaaagccattgtcacggcgttacagtcgcccatttttctgttgactggaggacctggtactgggaaaaccacagtaacagatggtatcgtgcggacgtatgcacggttgcatgacctttcattggatcttgatcagtatacgactgacgagccatttccaatcatgctggcagcgccaaccgggcgggcagcgaaacggattagtgaaaccacccaactgccagccagtacgattcatcgcctgctcggtttaggtgttgacacgcaagaatttgcacctaatgagttaccaaatggcctgttgattattgatgagatgtcaatggttgacacttacttgttccggacacttttgacggcattacatcccggaatgaaaattgtcttggttggcgataaagaccagttaccaagtgtcggtcccggacaagtattcgctgatttattgcgcagcggcgtgctgccgcaaacagcgctgacgcatattcatcgtcaggatgccgacagttcaattattccgctagcgcatgcagttaatgctggcaagttgccggatgattttaccaagccgcaagttgatcgcagttttttggcgtgtgcgcctagtcaggtacctgaagttgtcggacaagtggtgcaacgagccgcagtcaaacaattctcgatcgcggatattcaagtgttggcacctatgtaccgcggaaccgctggtattgatcgtttgaatccgttactgcaaaacattttgaatccaaaacgcagtgcccgaacgaaagcaattcagtttggagaaacggaatatcgaattggtgataaggtgttgcaactggtcaatgatcccaaccaaaatgtttttaacggtgaaatcggtcagattgtcggcattactttgggcaaggaagccgaaagcaagacggacgaattaacgatagattttgacggcaatgaaatcacttgcaaacgcagtgattttaataagattacgcttgcttatgccacttcgattcataaagcccaaggcagtgagttcccgatggtgattttgccgttaaccttgcaaagtcgccggatgttgcgacgtaacttgttgtacaccgccattacgcgggctaaatcatttttgattttggttggcgaactggcagcctttcaggaagcagtcagtgaagtagccgttaatcgacatactgggctggtcgatcggctcatgaccgtatttggcaaaaccgttgcccctcaggttgctgatgcttcagcaaccaaggatatttcagcaagtcccagtgagccgcaaattgacacaactgcaattgacttggataatgaagttaaacaacaaccaccggcagcgcaccaattaacgcctgccttggtggcttctcaacgaatcgatcccatgattgggatggatggtatcactccgcaaatgtttatgacgaaggagaattaactagctatggaggacaacatacgcaagtcactggtgattaagccagtgacgcctcaggatctcgagcagttcaacgatctattaacttatgtgtttcaagtgactcaaaaggacttggaacaatccggttatgaggaaggggagttagaacgagctaagcgtccagttttagagaaatcggatgttttgggctggtttcacaaagatgagcttgtcagttcactggccatttatccttgcacagtgaatattcacggcacattatacaaaatggctggtttgacaggggttggcacgtatccagagtatgccggccacggtttgatgcacgatcttgtccgacttggcttgcagcatatgcgtgaccacaagcagtggatttcgtacttatatccttacagcatccctttttaccgaaaaaagggatgggaaatcatgtccgatcatctcacttttgacgtgaaagacacacaattacctaaacaggtgaatgtgcccggacatgttgagcgtctggaaatcgatgatcctgatgtgattgaaacgtataatcgcttcgccatgaaaaatcatggggcgatgatccgcaaccagttgaattgggacgaatactggcgttgggaaaacgaggaggagcgtacggctggtgtttattatgacgccaacgatgaaccacaaggctatgttctatattggattgccgacgaggttttccacgtcaaggaaatgatttacaccaaccaagaagcccgagtcgggttatggaactttattagtgctcatttttcaatggtgacgcacgttaaaggtaacatttacaaaaatgaaccgttgcactttttgttagatgatggtgatatctatcagacgatcaaaccatactttatggcccggattgtggatgtgaaggcttttctgaagcagtatccgtttgcggctgaaacgcctgagtcgtttcattttgtcgtaactgatcctttggcgccgtggaacaatgggacctttggggtttattgggacgaaaaaagtcaagttcaaattactgaccggccggtgggtgaggagataaaaactgatatccaaaccctaacaaccatgttgatgagttatcggcggccatcgtatttggcccagattgaacgactttttgctagtaagcatgcgattaagttgctggaaaatgccattccaatggaagaaccttatttttcagattatttttgatcgtcatgttcaatcacagaaaaagcgctgcacctaccagaagaaaactggcggtacagcgctttttgatcggtttaaatactgcgatcaatccaaaatttttgtttggccattgagaagtcgatttcaaacggccgtgttcccatttcctcgccatccatctgaccaaactcgagcgaactggtctcaactgttaacttgtctgcgtggaaaatgtgagtagcccgacttgtcggttttttaccacgcatgagttgaatcatcgccaacgcccatgagacgatattaaaccattcaacaatcacgagatcaagtttcccgtcggttgggttagccggtttgtaaagacgaatgccaccgccaaaataaggaatgttggtggtggtgcagatataggcgcgatgaaaaaaatggcgaacgcctttttcatagacggcaaccgggaagggacggcgagtcatcagcataccgacaacatgaaataagtaggtgagtttaccaagatgcagcctattgagcaattgcttactatcactgcggttagcagcattaacaacggcagcgtcaaagccaataccgatattattcacgaaatagccactttcgccgcgggtgcgttcatgaaatcgcccgatatcaatcgtgaccgcttctgtagcctgtaatacttgttccagcgcatgcatcggatcttcagacataccgataccgcgagcgaaatcattacccgatccggctggtacgtaagcaacaggaatctctgactggcgtgtgccagctaacccattgatcgcttgattcaaggtgccatccccgccaatgactaacaaaaccggatgctcacgtcgattgaaatcaccaatttgctttgtgatcacgttggtatgtccgggatagcgggaagttttgatggcataagccaaatgacgctgatccaaaacggccttcacttgtttataaattggaatcgacgaaccaccgccagccgccggattatagataatataataaaaaacagccgtcatcagctttcctcctaatagacacgcactcaattataccgaaaataaggcgaaaaacaatggaacagtgacgaccttattgtcatcaaacgaacattttttgaagaggcagatgactacgaaccagcaaagtgtcggtccagcacctagcaaggcggcaacaggattttaatcatgatttttggtaatagatgccaataaaaaagccacgcgacaagcacctaagtggttgtcgcgtgactgttaatcattttcagttaatgagtgacgttgccagctatctgaccggaatttagagcaaaatcagcatcggtaaaataaccgggtgtcgttctgttttgtcgaacaaaaattcttgcaagttgctggtgattgcatcttttaagctagcttccgtcaccttttcactgcttgagaaggttgacttaatggtgcgatagacgcgccgctgagcctgattaatcaactcgccggattcacgcatatagatgaagccgcgagaaagcagatcaggaccagctaagaccgcttgtttttgcatattgatcgtggcaacgaccacaaccaagccttcctcagacaacatgcgccgatcgcgaatgacagcattaccgatgtcgccgacaccattaccatcaatgtaaacatcgccagcagggaagtgaccggcaattcgagcactatcttgcgtaagagctaatacatcgccattttccataatgtagcaattcttttcagggacgccgcattgttgggcaagttcgcaatgaatcttttgcatccggtattcaccatggcaagccataaagaattttggcttgattagccgcaacataagcttctggtcttcttgaccgccatgaccggaagtgtggacgttgttgaccttgccatggatgacctcggcaccagcttcacttagctgattgatcacgtgattaacactgacagtattgccgggaatcggattactggagaagatgacggtatccccaggttgaatactgatttgtcgatgcgtgccattagcaattcggctcagcgctgccattggttcgccttgtgaaccggtacagaggatcatcactttatcagctggcatcgaattaagttgatgggcatcaatcaagacgtcatcagggatgttaaggtagccaagttcgcggccattgaccatcgcagtttccattgaacggccaaaaacagcaattttacgaccgtgtgccattgccgcatcagctgcttgggcgatccgtgaaatgtttgacgcaaaggtggcaaatatgatgcgaccatcaattcgatcaaaaatgtggcgaattgacttgccaacaaatcgttctgacttagtaaatgtcggtacttccgcgttggtcgaatccgacatcagtaccagcacgccttcttcggcgaaccggcacattttttggaagttaggggatggctgatcgccaactggcgtgagatcaaacttgaagtccccggtttgaatgacgatgccttgcggtgtatgaaccgcgatccccagcgtatccggaatactgtgggtcgtgcggaagaactcaacactaagttttttgaacttcaacacggtgtcttcgttaatttcagttaatttggtagtgcgtaacaaaccgtgttcttcaagtttgccacgaatcaaagctgctgctaacggaccagcgtaaattggcacattcggtacctgctgtaagaagtagggaataccaccaatatgatcttcatgtccgtgagtaataaccagtgctttgatcttgtctttgttttgaaccaagtaggaataatcggaaatgacataatcaatcccaagcagatcatcttcagggaacttgatccctgcatcaatcacgatgatttcatcttggaattgaaccccgtacatgttcttcccaatttcacctaaaccgccgacagcaaagacggcggtttcgttattcttaatatttaatttcatataattagaaagttgtcagcttaaagttggctgacttttcctcgtattccaggaagtttccggataattcctggatgaattcaatattataaggcgtgttcttttcaacaagcgcacgcgcttcaaccgcagatggcgcctcgaggtaaagcgtctgggttgtttcccgtcgtggattttgaatcttgtctttctgatataagactttgtagatcatgatggactccttccgtggtacaaaaagaaaggaagtgcaacaaaacggcttccgaaaaaaaggacataccatcaagatggaaaaccacaacagacatggtctatcttattgggatggccgatatttctcgtcgttcgaacccgaaaacaggcatacctgcgctatttcgtcgttctatttctgtcacaactcctaaatactttatgaccgatcgatttgttgtgaaaacaacagctagcaacagtctatcatatttgaaacggtgtgaacagaccagagcgtgaaccagcccggttagaaaaaccggagtgtaagtgctactcaacgtgatgtccggagtgaggctattgcgttcaaggttgttatacgtaggtttctgaactggcgaccgcggttatgcggcaattgtaaggtctatccttgtggtgctaatgcggctggcacactgatcctagtactctcttaggaatcaaaccagatgatgcccacgagtttatgaccagctattattgtcaagctaacctccgattgcaagaatcacattggcgatagcatggttgttctgggtataataaaggtaagaatcaataacatattggcttttgaagggagtggacgttgtggtctggcttatcgttgttctagttctgatcgtgctcatcgttttgtgggtgctcaggaagcgctggcggcgtaataaagcaatccaaattctgcttcatcatagccagcgactaagtgatcaggtcatggatgctgctttaacatcacttaaaatccctgtccaagaacctttgacttcaaaaccaattacggacatttggggtcatggtgtgatggcgttctcctatattttccccaagagcttttccaccattgatcagcatcaattagccgacgctttgcaaaaagcggctgaagaattggatattgccagttccgatccggcattaccgccttttgtgatcacggattactttgaactagaggggcagcaacatgttgatctcgcttttattgctaatgaggctaccatagaatatgtccgcgatgtgaatcgcgttgcttaattttagaaagtgtcgaatggaggggttcaagtgaacgatgatcaggatttattgatgcgtcagatcaaaagttttgcccaaggattaggcgctgtgatgagtaagaaagatcgacgcccagatgatccagtcgtcgttttccacgatgcggaagtcagcttggccagctatcaagcaaaactgataactgaagtgaaggaaaatggcttttcggcagctaaagcacttttgacaacatggcgggacacccgcttatcacgacgacagtacgaagacttaacggcatggttgcagggacaacgatttgtgtataaagaatcgtaagttgggtgaaaaatagtgtcaaaaaaagaaggctttaagccttctttttagtacaaacgtattttacttgataatgacggcatccgggtcgatggtgaaaggatgttccttattaatatgatcgtaaaacaggacgccatttaagtgatcgatttcgtgctggcaaacgatagccggatagttcttcagacgaatctttttatgttcaccggcttcattttgataactgatggtaatccgatcagcccggacgacatatccgggaacatccttatcaacggacaggcaaccttcgccttcagccaaagcagcatgttgaacgctgttgctgatgatccgcggattaatcaaaacttctttaaagaggatttcattatcgtcaccgggaaccaaaacagcagccatcgccttgctttgcccaacttgtggcgcagctagtccaacgccaggacgcaaatgatacttttcgttttgttcttcatcttggctgatgaccaagtaagccatcatatcatgcgccagttgcttgtcctcgtcagaaagtgggaacgtgactggctttgccgtttcacgcaggaccttggccccatcgcgcgtgatatccttcatcaaatacacaatctgtacctccgttcatttcttctactagattagcacaggaccagaaggctgaaaagcttcgcgtgcaagaggtttgccttaaatgctgcaatagcagaaactttttctgtgtctgggtgataagcaagaaaaaaactatttttgaagctttgctcattttcaagaaattcacgctatttcgattcataaagctacagaaaaaataatagctctgtatcacttagaaagacaaatacaaaatgttttttgtctaattgatgattcgcaagttttatgttctaaccaacaacctttttgaatcgccatgattgttcagctgtgctcgattcggtgaaacatttgacattcggttttttttaccctactatatagaaggttaaacaaatacggtgctttccgttaggtgaggctcctatacgaacaatgctgctgctcagaaacatcgagagatgccaattgagtcaactgcgtctgcccattaaggcttacgctaatgcagctgaagctcgcttctaggcgtatagtgctaaaactaaacgattgggatgctttttctgcacgctctcaatcggcgtgcaatttttttgcctaatgaaaagctgaggaaaaggtggtgagcataatggaacaatcttcaaagagtagcggtagtagtagcgatttagctgatcccggaaggcccattgtgctgccgctacgatctcttaagtgaaattaatggatttggcagcatcgcggtccttctcgggaaacgggaaggagtttgtcgatgttgatgatggtttcgagtggcctgtcacgctacgaagcgcaaaaggcccaacaaacagttacaccacgtcctaatacgatcaacaaggcaagtctcttcttaccgttgttgatcatgactgccggtgtcagtggcttgatcagtgtgatcactcgcaactggcttcttacagttgttatcggcgtgttgcttagtatgatgatggctgtgatcgtttatctgctcacagctgctacccgacatcagggcgatcccaaacagacggttttggttgtacgcgagggcttggttcgccaagtgagcgcaaatgaccttgtcgtcggtgacgtcctgatgttgacgacaggagaaaaactgcctgttgacgttgcgttggctcccgatgcacacgtttccttgccaagtgatttggccgggctgctggctttgattggtcggcaggtaccagcgggggtaggcattgctggcgctgtgatggcgaccgatgcccaagcaaccgtcacggcggttttgcgtgatggtcttgtcgaccatgcctttgcacaattgaacggaaagacggaaaatcatgcgccagcttcacttgtaacgagtgcggcagttggttttgtccttgcgctaaaacagatttttcgggtatccggcattgctgtatcactcctggcaagtgaattgttaagaagtaaacaagtaaatcgtgcacagcaggttcggttacatgccgaccttgcccaacacgccaccttggttggcgccatgaaacatcacagtaaaacaagtgattttcggcacaaccaagatccggtctcgtgaagcacgatgaatgaatccattaaaagaggcacgcgcttgtgaagcgacgtgctctttttgtgtcttattttttataaggttctgttatagtcccattcgttaaaaaatgaggcacaacaagctcggaaaaggattcccgccagtgctgaaataaaacgcttgcaaggataaaaccgcaatgttacgcttggtttgtaaagattttcattagtacagttttcctgcgttaatgacaacaggaatggaaagaggttctgattatggcaaaacagcatgctgcagttgatttcaagaaactgttggaaaatcaagatgccgattttaagccgaccattcaaattctggatgaagcgggcaaggtcgtcaatcctgatatcatgcccgatctgagtgatgatcagttggtcgacttgatgtccaaaatggtttggcagcgggttcttgatcaacgagcaaccgcgttgaatcggcaaggacgattaggtttttatgcgccaagcgctggtgaagaggccagcatgattggcagccattcggccatgaaaacaacggactggttgttacctgcttaccgtgacttgccacagttgattcaacatggcttgccactggataaagcattcttatggtctcgtggtcatgttgccggtaatgaatacccagaagattttcacgcgttaccgcctcagattattattggtgcgcagtacgtccaaacagccggcgttgcactcggcttaaagaagaatggcagtgatgaagtggccttcacgtataccggtgatggcggcacgtcacaaggtgatttctacgaaggtgtcaactttgctggtcatttcaaagccccagcaatctttattgtgcaagataacggctttgcgatttctgtaccgcgggccagtcagacggctgcgaagactttagcgcaaaaagcagttgctgctggtattccaggtgtgcaagttgacggtatggatgccctagctgtctatgaagtgacaaaagaagcgcgcgcatggaccgccgctggtaatggccctgtcttgattgagacgctgacctatcgttatgggccacatacgttatctggcgatgatccgacgcgttatcgttccaaggagacagatgagttatggcaaaagcgcgatccgttaattcgaatgcggaactacctgactgataagggactttggaacaaagacaaggaagacgccttaattgatcaagttaaggatgaaattaaggacgcaattaacaaagctgataaggcaccacagcagacggtatcccgcttcctaaaggacacgtacgagaccgcaccgcaaaatgttgctgaacagctggcagaatttcaaggaaaggagtcgaagtaaccatggcacaaaaaacaatgatccaagccatcacggatgcgcttgatgttgagttggcgaacgaccctaagaccttggtattcggcgaagatgtcgggaaaaacggtggtgttttccgtgcaactgatggtttgcaagcaaaatacggtgaggatcgggttttcgataccccactagcggaatctggcatcggtggtttgtcgattgggttggcattgaccggttggcggccaattcctgaaattcagtttttcggattcgtttttgaaacgatggacagcattggtggtcagatgtcacggatgcgttaccggatgggcggcactcgctcaatgccgatcacgattcgggcgccttttggcggtggtgttcacaccccagaaatgcacagtgacaactttgaagggttaattgcgcaatttcctggtatgcgtgtcgttattccaagcaatccatatgatgccaaaggtttgctgattagttcgatccggagcaatgatccagtattgttccttgagcatatgaaactttatcgttccttccggcaagatgttccagagggcacgtacacggtaccgttggacaaagcggcggtgacccgcgaaggttcagatgtatcgatcatcacgtatggtgcgatggttcgcgaagcgctgaaagctgctgataatttagccaaagatggcattcaggctgaaattgttgacttgcggacgattgcgccacttgatgtcgaaacgatcatcaattcggtcaaaaagacgcataaggttgttgtggtgcaagaagcacaacgcatggccggtgttgcatcaacggtgatcagtgagatttccgaacgggcgattctgtcgcttgaggcaccgattggtcgggttgccgctccggataccccgttcccatttggccaagctgaaaacatttggctgccaaatgctaaggatattgaagctaaagtccgggaaaccgttaatttctagaaagaagaggtgccaacatggcttttgaattcaaactgccagaacttggcgaaggcttggcagaaggcgaaatcgttaagtgggacgtcaaacctggtgatgacatcaaggaagacgataccttacttgaggttcaaagtgataaaagtgttgaagagattccatccccggtctccggcaaaattttaaaaattcttgttccagaaggggaaaccgcgtcagttggtgatctattggttgaaatcgatgatggctccggaccggcagctgcaccggctgcacctgcgactgcaacagcagcccctgcgacacccgctccagcaacgcctgctgtgcaacctgcacctgcgcaatcggtttatcagtttaagttacccgaactaggcgagggtttggcagaaggcgaaattgttaaatggtcagtcaagcctggcgatcaaatcaaagaggacgacacgctgttagaagttcaaagcgacaagagtgtcgaagaaattccttctccagttgccggaacggttgttaagattctggtaccagaaggcgaaaccgcgacagtcggtgaagcgctggttgatattgatgcaccgggtcataatgacacatcggttgctactgaggctggcgctgcaccgcagccggttgctgcaacaccggctgcgacgccagctgcaccagcagcgggtggcgtgccggccatcaccgatccgaaccgggaaattttagcaatgccatctgtgcgtcagtatgcacgcgaacagggcattgacatctcacaagtgccagcaaccggcaaacatggccgaattaccaaggctgatgtcgatgcattcaagacgggcgcatcagctgcatctgcacagccagcagcccctgctgctcaggcacaaccgcaaccagccacagcaaagccagctgcaccggcagcaccaaagccacaagcagttgcaccatacgtttcgagtggtaatgaagctgaacttgaaacccgtgaaaagatgaccccaactcggaaagcgattgctaaggcgatgcttgcttctaagcaacgtagcccgcatgtgacgagttttgatgacgttgaagtttctaagttaatggctcatcgcaagaagtacaagcaatacgcagctgataagggtatcaagttaaccttcctgccgtatatcgtcaaagcacttgtgacggtgttgcgtgaatatccagaattcaatgcgtccattgatgatacaacggatgaaattgtctataagcattacttcaacattgggattgcaacaaatacggatcacggcttgtatgtgcctgtgatcaagaatgccgatgcaaagagtatgtttgaaattgctaaggaaattagtgaaaatgcccagaaggcttatgacagcaaactaaagccggatgaaatgcgcggtggctccatgaccatcagtaacgttgggtcaattggcggcggctggttcaccccagtgatcaatcaacctgaagttgcgattctcggagtgggcaaaattgctaaggagccttatgtcaacgaagacaacgaaattgtggttggcaacatgttgaaattaagtttgagctatgaccatcgtttgattgacggcgcgttagcacaaaccgccttgaatctgatggataaattgttggcagatcctgatctgctgttgatggagggataagcatggttgtaggcgattttgcaatcgatttggataccgtcgtcattggttccggccccggcggttatgttgctgcgattcgcgcagctgaaatgggtcaaaaggtgaccgtgattgagagcacgttcattggcggtgtttgtttgaatgtcggctgcatcccatcaaaagctttgatcaacgcaggtcatcgctatcaagacgccttggaagcaagtacgtttggcattaatgccaaaggtgctgaccttgatttcacgaaaacccaggaatggaagcaaaataaggttgtgcatacgctgacaagcggtgtgtcgatgctattcaagaaacacaagattgacacgattatgggcacggcgttcttaaaagatgaccatagcctgcgcgtgatgcaaaaagattcagctcagacctatacgttcaagaatctgatcatcgcgactggcagccggccaatcgaaattaaaggctttaagtttggcaagcgcattttagattcaacagggggtctgaatcttcctgaagtaccaaaagaatttgtcgtcattggcggcggctatatcggctccgagttggcgagtgcgtatgctaatcttggcgcgcatgtcacgattcttgaaggcacaagttcgattctgccaaactttgagaaggatatggttcagctagttctgaattccttcaaaaaacgtggcgtaacagttattaccaatgcgatggctaaagaagctgaagacactggcaaaggtgtcaaagtgacgtacacggccgatggtaaggaacagacgattgcagctgattatgttatggtgacggtcggacggcggccaaatactgacgatcttggtctcgatattgtcggggtcgaaacaactgatcgcggtttaatcaaggtcgattctcaaggccggaccaacaaaccgaatatctatgcgattggcgacattgtgccaggtgcagcattggcgcataaggctagctatgaaggtaaagtcgctgccgaggccatcagcggcaaagccagtgcggttgactacaaagcgatgcctgccgtttgcttcacggaccctgaacttgcaacaactgggatgacagttgccgaggcgaaggataaagggatcaaggctaaagccagcaagttcccatttgctgccaatggtcgtgccctcagtcttgcccagacagaagggtttgtccgcttggtcactaatgaaaacggtacggttatcggcggccaagttgctggcgccggtgctagtgatttgatttccgaactgaccgttgctgttgaaggcggtttgaacgttgaggatcttgccttgaccattcatccgcacccaacactgagtgaagttatcatggatgacgctgaagttgcattgggactcccaatcaatatttagtatctgatagagatgtcatgaagcagtctgatcttcttgatcaggctgtttttgtgtcatttggttatcgctaatggcgaatgctgtgagcatggcaacagctaatttttacaagaagatgagaaacggctaatatttcagttagttaacaattgcgtctaaacccctttttaattttgtcttaagattctgcttccgttaaaatgtaactaatggagtggaggggaagggttttcatgcaaagagtcgtggtgagcggtgccagtatcgggacccaagggctgttagaaacattaattgcatcacagttgctgttgacggtgggttgttatgaaccagatgaatcattgattgatatggttgggttgacagctttaagtcaaatatgtcaaaacacatttgcaaaagtcacgccgaaagttttaaaagcggcggatattttaatcttgaccgatacgggatcacctgatgccgatgattttattgagacgaatattgcggcaattcgcaaagttctcaattcagcgatggcggcaggcttcacaggtagaatcattgttgcgatgacacgtgatgaacttttcacgtattttgcgcaacgtttttccggagtgaataaaagtcaggttgttggacttggtacgtttggtgcaacgtggcgatttgaacaatttctggctgctaggttggcagtaccggcgaaacatgtgacggcttatgtggtaggtacgcgacaagccccagtgttgatttggagccgagcttacgttggtgcaacgccggttttgcgcttattaaatgatcagacgatttttactgatggcttggatgcagttcgaagctttttgaggagtcccttgaccgtcttgcttgggaggttggtgattccgattattgcggcgtatagtggcgatagtttgattggcacgctgacgcatctgatggatgtagaggatgacacaggtcaggtttatagttcgccagtcctcttgaatgatagtggtgttgtgacgctcgccacagttgctggttcggatgatgaggaagctgcgttgagtcaaacgaaacaaactgtacaggatcaaattaaggcgatagaacaaggagctagtaaacatgaaacctaattatgcctatccactcgacattgactggacaactgccgaaaaagtaaaagtcacgaccttttataccttagtcgaagatgcatatgaacacggtgttgatcgtgataatctgcttgcagcgtaccgtggatttaaggaagttgtgccagataaaggaaccgagcgcaaattggatcgggagtttgaagcactgtccggttattccatgtatactgttatacagatggcccgcaaaggcgtgagccaaaagattagggtaagggtgagttaaccatgacacaagatccagaaatgttgcggcaaacgattattagctggtttgctgctagtcgcaaacaaattctaaccgcaatggccgccccattagatgttgccaccaaaagtaatcgcaacgatttggtcaccaatgtcgacaaggcgaatcaacaatttttgattggcaaaatcagagaggcgtatcctgaagccggtatcattggtgaagaaggacatgagcacgatgacactgatttagctggtctcgtcttctttgtcgatccaatagacggcaccatgaatttcgtcaaacaacaagcacattttgccattatgattggtgtttatcaggacggtgaacctgttgtcggcgcgattatggacgtcatgcgaaatgaagtgcttagcgggggcccaatgattcccgtcacccatgctggacaacaagtgaaggttttgccagacttgccgcttaaggatggcttgttaggtgtcaatggcccgatgacgattaagaatcggttgcatctaggcgatatcgcgttgaccagttctggcgctagaatgagcggcagtgcaggaatggagttcatcgaaattgcgctgggtcgacagatcgggtatgtgtcttacttacagccgtgggacgtagcggctggaatggcgattactaagggtcttggcgttgttttcagccgtgaagatggcgcaccaatcaacttgcagcaaccaggtgttgtggttgctgctacaccaaaggcacatcaaacgattttgacgatgatggcggatggcggcaaagaggcttaagctaaaccaatagacaaatcatgatttctggcgcaaactaagtggcgccagtttttttcttaataaaagggtcgcgtgatagcccgctttataagaaaatgcaaggtctgtgattgcgtgaagcacttcacttttcagaaaatccagacagacttgtcattgtgtgttataatttcaaatcgtataactgtgtcagttgctggcacttttttaatgcggtaggcggccagtagtgccagcagaaaggaagtataaatcgtgaaaacacgtgacgatattcgcaacattgcgatcattgcccacgttgaccatggtaagaccacattggttaacgaaatgcttaaacaatcagatacacttgatcaacacattcaattacaggatcgggcaatggataccaacgccattgaaaaagaacgtgggatcaccatcctgagtaaaaacacggcagttaagttcggcgatacgaccatcaacatcctcgataccccggggcatgctgactttggtggtgaagtggaacgggttatgaagatggttgacggcgttttgcttgtcgttgacgcttttgaaggcccaatgccgcaaacgcggtttgtcttgaaaaaggcgcttgaacagcatttgacaccgatcgttgtcatcaacaaggtcgatcgtccaggtgcgcgtcctgaagaagtcgttgatgaagttctcgaattgttcattgaattgggcgctgatgatgcacaactggaattcccggttgtctatgcttccgctgtcaatggcacttccagcatggattccgatttgtcaacgcaaaagcacaccatgaccccgttgtttgagaccatcgtcaaaaccattccggcacccatcgacaacagtgacgaacctttgcagttccaagttgcgatgcttgattacaacgattacgttggtcgaattgggattggtcggattttccgcggcaagattaaaatcggcgacaatgttaccgttatgaagctggatggttctcaaaagaacttccgcgtgacaaaactctttggtttctttggcttgacccgaaccgaaatcaactctgctaaagccggcgatttgatcgcggtttctgggatggatgacatcttcgttggtgaaacggtgacggcagctgatacgccggaagctttgccgattttgcggattgatgaaccaactttgcagatgatgtttgttgcgaatgacagtccatttgccggtcgtgaaggtaaaaatgtgactgctcgtaaacttgaggagcgtctgaagtcgcaattgcagacagatgtgtccctgcgcgttgacgacactgatcaggcaggtgcctggatggtttccggtcgtggcgaattgcatctttcaattttggttgaagagatgcggcgtgaaggctttgaattgcaattaggtcgtcctgaagttatctatcgtgacattgatggtgtcatgatggaaccgttcgaaagcgtccaaattgacactcctgaacaatatactgggacagtcattgatgcgatgagccaacgtaaaggcgaaatgcagaacatggagaacgaaggcaacggtcaaacccgtttgacattcttggcgccttctcgtggtctgatcgggtactcaaccgaatttctctctgctactggtggttacggcatcatgaaccataccttcgaaaaatacgctccggttatcaagaattgggaaccaggccgtacacaaggtgctttggtttccatcaacgctggttcagcaacgacgtacagtctgcaatccgttgaagaccgtggccagttgttcatcaatgccggcaccgaggtttatgaaggcatgattgttggtcaaaactcgcgtgaaaatgacattgcagtcaatgtcaccaaaggcaagaacttgaccaacacccgtgcagccgggaaagaccacgcagcagccatcaagacgccaaaagatatgacgcttgaagaatccattgaattcttgaatgatgacgaatactgcgaagttacccctaagaacattcgcttgcgtaagaagatccttaacacaggcgaacgtcaaaaagcggctaagcgcaagaaaattgccgcatccaagtaaataagttggtcaaaaagtcgtctgtaaaaggcggcttttttgatgtcttgatcacaataattgtgattgttagggctctacgtcaactggtgttgaagaataaatttatcatttgaggcggttctccatttggagagccgtctttgtcatgttatgccgtgatttggtagattcgtttgaagaagttcagctgattcttgaagccaaaacaggatcgtttgagtgacttgatgaggcggttaaccccttcgatcggaccgttggaataagggctggtgacagcggcgagaacagcgactttgtgtcgcttaagcgtcgcgatcgtcatgtccattgccgtaccgtttggctcgtaagtagctaacaggtttgccagttccgtgggatgtttcttcaccatcaaggcatcatgaagcgctaagtaggtctcgtaggtttgcttgagcttgggctcagtatcaagtgcgatatcgatggcctcctgttgcgtgacgtattcattcaaaccaaacaggaactgtttgtgtttagcgtcaggcgcagtttgatgaaaaagccgccagtttgtcttcatgatcttataaggacggctgtgtttgtcatcaagctgtttgagcgcttggacgcgtacctgatcaagggcacgagccgcaagttgaatgatatggaaccgatcaatgacgacttgggccttggggaaaacctcatgaataatcgtctgataagctgcattcatgtccatggtgaccgtctggacccgagtgcgttcagcgagtgaataatgagcgatgaagaagtttttaatcgtgcggttgaatcgatcaccaagcaaggcaatcagacgatgtgaatcggcatcaagacagataaacgacatcatgccatgagtagaacggaactcatcaaagcagagtcgcgtgggcagccggcgagccggtcggagtttgagattttggtcaatgatccgttgaaccgaggaagctgagattccgataatacgggcgatggttttgactggcaaccgttcatgcgctaacttcatgattcgctctgtcatgtgagtggcgatcgtgtggttgggttgcacgagtggcgtcttggcactgactgtgtggtaacagttatgacagcgccatcgttgcttgtgcaagtcaatgactgtcggcatttcaaccccattgaggacgcgcacgtgggccgtataaaacccgttagggtgcaaggcctcaaagccacacagtgggcaccgggttaaccggtaagtcagctcggcatcaatcacatgatactggcggcgacgtaccccgttgccgcgatattcatgacgaacaaaggcaactttgatattatggtctggtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttctcaacaccagaaagtgtagacccattgttagacaaggcttaacttgtcgactgagcggttgttaaatcagcatgtattggtgtgaatgaccgcctgaaaaaacagtttttagtgattaccgcagaacacggcttggagcgtgaaggcgatatgctataattagtccattaattgcttgaaaggccgcgttttcattgatgaataaattacggcacgtggattacttcatattagttccgtacctcgttttatgtgcgatcggtattgtcatggtgtactctgccagcgcttattgggttcaacggcaatatggcgttgccgaaacgaaatacttgattcaacaggcactgtttgtcctgctcggtatcgcgactgtgtttttcttttataatatgtccttgaaggtggtccacaatcgttgggttctgttgactttaatggccggactagttgtgatgctaatctatctcattgtgcacggccgcgccgttaacggggctgctgcatggatcacgattggcgggtttcgcttacagccatcagaatttgctaaaatgattttgattttttatctggcgcacatgctgacatcgcgcgaggatcgctttcaacaagaggactttcggctaaggcagatgtggcagccattgtttgtcgctggtatgatcatgcttctggtttttgtcgaaccagataccggtggatttgccattcttttcttgattacattggtcgtggttatgtccagcgggataccgatgcgttacggttttttgtgggtcttgatgttgatcgcgatcacagcactgggctactacatcgtgtcgcattatcattttcccggattggagaagaattacggctatcaacgattagtggccgccattcatccgtttgctaaagcgaatacggttggcaatcaggttgttaactccttgtatgcgatcaatcacggtgggctgtttggtgttggactaggcatgggcagccaaaagttaggctatctgcctgagccttatactgactttattttggccgtgattgccgaggaacttggcttggttgggacatttgtcgtattgagtttgctttttttcctgatcatgcgtttttatctgatcggaattcgttccaagaacacctatcacacgctgatcgcgtacggcattgccacgatgatgctggtgcaaaccgttttcaacgttggtgctgtgactggggttttgccagttaccggggtgacgctgccgtttatcagttacggcggttcgagtatgatcgtgctgtcaatggcgatcggcattatgttaaatatcagttatcatagtgaacgtacgcaacgaaaggtagagaagacgcatgcataaagttttagtcgctaatcgtggcgaaatcgccattcggatttttcgtgcctgtgaagagcttggtcttaaaacagtcggtatttttgctaaagaggacgctttgtcaattcatcgattcaaagcgcaggaaagttatcaggtcggagcaggaaaagcgcctatcgctgcctatttggatatggacgatattatccgaattgccaagcaaagcggcgcggacgcgattcacccgggctatggcctgctttcagaaaatgctgagtttgcccggaaagttcgggcagccggcctcatttttgttggcccgcgttcggaattactcgatatttttggcgataaagttgcggccaaggaagctgctcacaaggcaggcttggcgactattcccggcacgccggaaccaacgcgcgattttagcgaaattcaggatttcacagccacacacggttttccggtgatgcttaaagcagcatcaggcggcggcgggaaaggcatgcgaatcgttcactctgaagctgaacttgaggccgtgtatcaaaatgcggtgaatgaagcgaaagctagttttggcgatgatcggatgtacgttgaaaagtacattgcctccgccaaacatatcgaagtgcaagttcttggcgatgagcatggccatttgttgcacctcttcgaacgtgattgttcagtacagcgccgccaacaaaaagtggttgaaattgccccagccgtggcattgccaacagccttgcgggcgcgaatttgccaaagcgctgttgatttaatgcaaggtttgcactatgaaaatgccggtaccgttgaatttttggttgatggcgatcagtactacttcattgaagttaatccgcgggtacaagtggaacacacgatcaccgaactgattaccgatgtggatattgtgcagtcacagttaaagattgcagcaggcgccgatctttttgctgatttgcatttgccaaagcaagcagatttgcatgaaaatggcgcggcgatccagtgccggattacgactgaggatcctgaaaacaatttcatgccagacacaggcaccattaatacttatcggtcaccaggcggcttcggcatccgccttgatgtcgggaatgcctatgctggggcagttgtcagtccttatttcgactccttattagtaaaggccagtgttcacgcaccgaatttcaccgctgccgtagccaaaatgcaacgcgctttacatgaatttcaaatcaccggcgtcaaaaccaatgttgctttccttgagcacttattagcgacagaaactttccggacaggtgaagcagaaaccgcgtttattgatgcccatccagaactcttgcaagttcaggcaaagcccgacacggcttcgcggttactgtggtacatcagtgatgtgacggttaatgggttcaaaggtgttgaacgacaggcacaaaaatattaccctgaattgcgctatgatgttcattttcctgctgccaagccgcaaaaagatttagttgccttgctgcatgctgacggtgcgcaaggggttactgattggattaaggcacaaaaccagttgctgttaacggacacgactttccgtgatgcccatcaaagtctttttgctacccggatgcgcactcgagacatgttgacggtcgcacaggatatgggcaatggcttgccaaatcttttttccatggaagtatggggcggcgcgacgttcgatgtcgcttatcgatttttgaacgaggatccgtggacccgtttgaaaaaattgcgggcagccttgccgcataccttgttacagatgttattccgtggcagtaacgcggtcggctatcaaaactatccggacaatgtgattaaagctttcattcaaaaagcagctgatgatggcgttgatgtttttcgaatttttgacagtttgaactggttgccacagatgacgctcagtattgataccgtcaaacaaacaggcaagcttgctgaggcgacgatgtgttacacaggcgacattctaagccatgcccaccctaagtatgagctggcttattatgttgatctggccaaacaattagttgcagccggtgccgacatgcttgcgattaaagacatggccggcttgttgaaaccgcaagcggcgacagagttagtaacggcgctcaaagatgcggtcagtgtgccgattcatttgcacacacatgacaccactggtaacggtatcgcgacttatgtagccgctgctaatgctggggtcgatatcgttgatgtggcgcaaagcagtttttccggaacgaccagtcagcctagtctagaaagtctttactatgcattaagtggcaatcagcgacagccagatgttgccattgaaaaggcgcagaagttgaatcgctattttcaggcaatcagaccttactatgccgattttagtaatggtgtgacgggtccgctaacggatatttatacagtccaaatgccaggtggccagtatagtaacttgcagcaacaagcacgtagcatggggataacggattttgaggccgttaaaacgatgtatgctcaggtaaataccttatttggcgatatcatcaaagtaacgccatcctcaaaggtggtgggtgatatggcgttgttcatgctgcaaaatcacttgacacccgatgaagtgttggcgcatggtgagcaatatgattttccggcctcggtcgtggcattctttaaaggcgatctcgggcagccggttggtggttttccgaaagcgctccaagcaaaaattctgaaagggcaaaaaccgttgacggtacgtccagggcaattggcgaagccggctgatctgaaggccgttcgcgcggcgttagtacaagccggaatgaatgaacccagcacagaagacgttttgagtgcaattctgtatccggatgtctttaatgcatacgcccgcaagcaacggcagattggaccggtgacgaagttggattcgccatcgtatttccaaggaatgcggataggcgaaaccgtgtctgtgccgattaaagcaggtaagacaatgattatccagctcaacgcgatcggcgaggcggatgcaagtggtatgaagacgctgtactttactgttgatggtcaaaagcaggaagttcaaatccgcgatgcgcatcagaagagcgcggggttgcggcatcagttggcggaaccgactgatcgtaatcaaattggtgcaccgatggcagggaaaattgtttcagttgccgttaagtccggtcaagaagtggcacaaggggatgccttgtttgtcattgaagccatgaagatggagacgacggttcatgcaccatttgcaggtaccgtcactcatctttacgtggaggcaggcgccttaattaagagtcaggaactgctggccaagcttcaacccggtgtgaccaagcagtgagtttggaaggtgaaaaaatgtttgctatcaaacagcggcaaggacttgtcgtttgggtgtattccctcaaacaattaaaaacgctgcgtcgatatggcacgattatgtatgtctcgcgccgcatgaagtatgtttatctttatttggatcaagacgagttggctcagacaagcgccaaactcagtaaattacgatttgttaaacgtgttgagccctcccatcggccagaattggcgactgaattcggtagcaacatcggccaatttaagccgactgaagaggatcttgaggtgaaagccaagccaaaacgtcgcttgcggccaagttcgactggcgatgagacatcagtaggtgatcacgatgcgcgtcattagtggagcatttcggggattgcggctgacggcagtggcaggtaaccaaacccggccaactgcagataaagtcaaggaatccatgtttaacatgctgggaccatactttgacggcggacaggcactcgacttgtatgctggcaccggtgcgttgggcattgaagcagtctcgcgtggtatggttcacgcgacgttggttgatcggcagtacgccgcaatcaaaacgatcaaaaccaatcttgcactaaccaaacagcctgagcacttcaccgttttgaagcaaccggtcaataaggctatccgtcagtttgcggaagctggccaacagtttgacttaatcatgatggatccaccctatgcgcaacagcaagtattggcacaacttgcggcgtttatcagtactaatttgctgcggccaggcgcacgtgttttagttgaaaccggtatggatgtgacttatcctgatgagatccccggctacatcaagctacggcgccaaacctatggggtggcgcaggtcttaattttagagcgaagcgaggaaaacaatgactaaaaaaattgcagtgtttcccggtagttttgatcctttcacgaacggtcatcttgataccgtcaaaagagctagtcggttgtttgatgaagtggttgtagcagccatgaccaacacgagcaaaaagccgcttttttccagtgaagagaaattggcgctgatcagtgaaagcaccgctgggctaccaaatgttaaagccatggcagcgcctgaacgattaacagttgaatttgcccggtcaatcggtgcccagtttatgattcgtggtatccgcaatgtcgcggactttggttacgaggctgatattgcgacggtgaatcatgatctcgatcctgaaatcgaaacagttttcttgctggcagacaagcaatatgatgccttatccagtaccatcatcaaagaggtcgcggcctttggcggtgacgttcatcgttttgtgcctgcgcctgtcgaagcagctttgtatgcgaaactaggtgacgctcatcaaaccaagtaatcagaaacgtcggcgctggctttggcttatcggactgttaatagcagtcgttttgttggctgtcttctttttgatcccaaccaattactatctagaagtgcccggttcagcggaatctttgaagccgtacgttaaagtcagtggcaataaagatgatgccaagggtgcctatatgttgacgacagtgggtgtcgtagggccagcatctccggcattacttctgctcagtaaggtgcaggcgcacaccgatattgtgtcgaaacaggatctgatgggcaatgatagtagcgctgagtatgatcagctgcaagcctactatatgaaaagtgccgctaataacgcggttgcggcagcattcaaagcggccaaaatgccagtgaaaacggaacatttgggtatttatgtcatgtccgtgctgccgcagtcgccattcaaaggtaagctggcgttaggagacacgattaccgaattgaatggccagcactatacaaccgctgatgcctatgtcaatgcgatcaaatctaaaaaggtcggatcaagtctgacactgacataccagcacaagggaaagaccaaacaagcaactggcaagctgatgcggttaccgcaaacaaaacgggcgggtattggtatcacactgacggagaacacggcggtcacaagtgaaccgaaagtgactattgatgccggtaacatcggcggaccgagtgccggtacgatgtttgccttacagatttacacgcaaattacacaccagaatctgcggcggggagcagtgattgccggtaccgggacgatcgatagcgatggtaatgtggggcaaattggcgggattgataagaaggtggttgctgccgatgccaaaggcgcaaaactcttttttgcccccaatcagccagctacaaaaaagctaaaacattatgatcccaattacgtcaacaactacgctgaagccgtcgaaacagcgaagcagattaagaccaagatgaagattgtcccggtcaaaacattgcaagatgtcattcgttacatggaaacttatgcaaaatcagcatcataagcgcttgccagttgatcgaacattggcatgaagagatggtgatgatgaagaactgccaaccaaggcagttctttttttcttggcctgcgtaatgtgttggtgaggtgagagagatgacgacacttatgttttggttgaaaacttattggtatgtaccgctggtggtgcttgtcggcgggttctttttctggcagcaaactaaggcagccccagcacaatcccagctggccgttagtgttcacaccactcgcagtcatgcatctaatgttcatggtcagtcgaccactatagcgtccagtaggcaaacaagaagcagtaccagccgaccaacccgcggatttgtgcatatcaaaggagcagtccaaaagcctgggctatatccggttcgtgctgatacgcgttgggatgcggtggttaaagccgctggtgggctcacagacaaagctgatatcagtcaggtgaatttagccaagctagcggtggatcaagaaagtcttcagattccagagaaaggtggcgctgttgccaccgcgccagcttcagggactgccagcactggcggcactgctggccaaacaaatgaggcggctggtagtcgtgcagttgtgaatctaaacacagctgatgttagccaactccagacaatcagcggcatcggtccgaaaaaagccgctgacattatcagttatcgcgatagtcatggtggatttaaggatgtggccgaattaaaagaggttcacggcattggcgataaaacgtttgagactttagcacctcagctaacggttggcccatgagtggtcggtttattttaatggcagcaggtttgcttgctggtatcttgattggcattgggggatggttgccagcttgtttattgttgctttggctactcgttaaaacgactcgcaatctggtcatagtcgtaagtttggccattctcgttgggttaggacgtggcttgattgatgcccagcagtggcggcaaccgcctgttccccaaggatcaattgtgatccctgcgacagcactcaagcttaaagaaggttacgcaagttttactggtcgagcagctaatggggtgattgttagtggtcgcggcagcgtcaatcaggccgtcgctgcccgactaaaatcaaataatcaaccactcgtgctgcacggtcagcatcaaataaaacgtctagcgccagcaagaaatcagtttgagtttgattacgcgacttatgtttggcaaacacagcagttagcctacgagttagtgaaaccgcaattgaatttcgagtcaaggtcgccacaaaatatagcagagttagttgatggttggcgggttcatttatttgactattttgagcaattgccaacaaaagttcgtcaatatgcaaaaggcctatttctaggccaacttgatgaagactttttgactcagcggcaagctttcgttgacttagggatctttcacgttttctctgtttcagggatgcatctttttgcaattattgccggtttatactggtttgcggcgcgcttgcgagtgcctcaagggttagttgatctgagtctaatcgtcctgctgccgttgttgttactcctattgccacttggtgctggattgtggcgcgcagtttggatgcgattggccggtattgtgaatgatcatttgcaacttggcttcagcgggcttgacttatttagcttcgttttaatggttaatttattttggcaaccgcgggttttgttaaccatgggtggtcaactaacttacctgttaaccggtttattagtggcgcttcctgccatgcgttcgtggcagctcaactggcgactagtacttgccagtatgccagtgattgcttggcacacgttcagcttcaatatattgacggttctttttaactggctgttaatgccgatctttgaacttggggtcatgccagggcttgtgatcgcgttgcttttgccacacgccaccttgacagccacttttgacgacggtttgcaattgttggaaaatggcttagttagtttaagccgtgtacctggccaaatagtcactggcgcttttccaagttggttagcacttatcggtattgtcgtgatgctgacggtgattgttgctaaacactggttggcggcggcttgctggttcgtgactgtctttggctggtgttggtatcagccaaattatcgggtggtcatgtttgacgttggacaaggggacgcaattttgattgaaaccccttttcatcaaggtgctttgttgattgatactggtgggcgaattttcgggaagacgaccaatccacctgtccgacgagccattgtgccatatttgcatgctcgcggctatgctcggctggataccttattactgacgcatccggacatggaccatgttggcgatgccccgttgctatctcagctaatgccagtcggtcgactgatcaccacagcgacaagcgttcagcatcaaatgattcaaaaagttgccaagcaagtgcaacatgtgcagctcgtggcggctgatgactggttgtgcattggacccgctaaatttcaggtcgtatcaccgaaagcgcagacatccggcgatcctaccaagacaaacgccgattcaattgtgctctatggtaaaataggcaacagcagttggttgttaactggcgacgccgaaaaagaagcggaagaaaagaatatcatgccgcgtcagctaacggccgattatttaaaagtcggccatcatggttcgaaaacatcaagtaccccggcattgatcaatagcttgcatttaaaagcagcacttatttccgccggtgtcgataatcggtatggtcatccccatccagaaacccttgcaacgttggctgcggccaacgttccatgggctagcactagcgagcgaggaatgctgtgggttgagccggggcaaaacaaacaggaagatcagctttttggctggttaccaacaaaggagcaaagcagcaatgcaggtccgtgattttatcaaacatcttaagaatggcgaacgaccgccgctgacattgattctcggtgaagaatccgcattgcgtcagcaggcacaacacgcgatagccagcatgattccggaagatcaacaggccatgaactttggccgctatgatatgcagcaaacgcctgttggtgcagccttgaatgatgcgacctcgatgcccttttttggggattatcgggaagtcgttattgacgatccgtattttttgacaggcgaaaaaaatgccgacaaagtcgatcatgatcttgctggtttgcaggcttattttgagaacccagtaccgtcaacgatgatggtcatcatcgcgccttataagaaacttgatgaacggaaaaggttgaccaaggcattgaaaaaggcggcgctcattgtgaatgcagcaccgcttgatgaacgggaggcgcgtgctgctttagcccaaacatttaagaagcaccaagtgaccattgatgcaccggcattggatacccttgtgcagcgcactaacggccagtattcgatcatgatgggtgaggttcgcaaactgctgacctatgccagtgatggcagcccgctgaccgttgcagcggtcgaagccctagtacctaagcagctcaatgatcgggtgtttgatttggtgactgatgttttgcgcaaaaatgctgcggccgctttggcgctgtatcgtgatttattggctcagcgtgaagaacccattcgtttgaacgcattgatgctaggccagtttcgactattgctgcaggtgaaattattagcaaaaaaagggtatagtcaaggcgatattgctggcaccctcaaggcccatccatatcgggttaaattagccatgcggcaagtggatcgcttaccttatcagcagctcgcgactgcctacagtggcttggttgatactgaaacagcaatgaaaacgggaactatcgataaggcgttggcttttgaactatttatgctaaagtacacaggacagcagtctggcaagcatgtgcgcggttaagcaacatcgtgcggattgcaaatgatcgttagacgcaaaaatcccctcggatagaaacccgaggggattttatttggcatgacgccttaattacttgttaagtagtgcagaaagacgactcttgtcgcggccggccttgttcttcttgatcaggcctttgctgtttgccatatcgatagcacgggcagcagccttgtaaagatcctgactgttgtcagcattttgttcggttgcggtcttgaacttcttaacagcggtacgcattgcgttcatttgcgcaatgttacgtacacgagcagcttcttgcgtcttaacgcgcttgattgcagatttgatttgtggcatgagatgttcacctccaacagtggattatgataaaactgcataagtttcaacagtcgctattatacagaaggcttgggggcaatgcaataaaaagttgtaaagggaaaatgcttgataggcaaaaagacttgcaatcattgggcagctccggtaaagtaagtaagtacttttgaacctgatacttagtttagcgaaccaccgacgctttactcagtttcaggcaatactcagaaaggtggtacacacaatggcaattgaacaaacacaaaaagatgaaatcatcaagcagtatgcacggcatgatggggatacgggttcacccgaagtccaaatcgcagttttaactgcagaaattttggccttgaatgaccatttgtccgttcataagaaggatcatcatagttacgttggtttgatgaagaagatcggtcatcgtcgtaacttgcttgcatatctacgtaacaaagatattacgcgttaccgtgatctgattaaagcattgggtctgcgtcgttaatttaactttgaaaggtcgccttggcggcctttttttgatggttacaaactagtctgattagaaagcggcgtgtgaaaggcttttaaatgtagtctgggaaacgccattgtgttcaagccttttaggtgtagactatttgcgactacgagcgcgttatgaaaaccggaatgccagacaaaggagtaagcatcatgggagcggaataccgtcaacgttatgaggatcatttgttgagaatcacggttttagcagcgacacatcagataacggttgtctttgcagcaatggctgctgatcagtgggctgctgcggggatcactaaaaaaggagcagtgcagaccgcctcagagggcattgcgctgcctcttcagcaattagtgcaggcgattgcgattggcttaattggtaaaacaccaaccttatcgttgttgccgtcagagttgcaaaaaacggtaaccactattttacaaaatcgtgaactgctaatgacagcaacaccaacaggactgacgatcatgcctcaagtggctggtacaacggtggacttttggcttgctggtgatgccgcgtttttaactgtaccggatgatcgcttgcaaccgatagatttgaaagcgtgggtgcaaaatatcctaccacaagctcatggcatgggcttcggcccagtaaccgggcaagcagcgttggcgatcctagctaacgaccgtggcaaacatctagcagctggttgctcatcagaagttgcagtcgttttaatggcggatcatgaagtagccgcctatcatcttgacgcggcacagacgagtgatgctggctatcagacagccgttgcagcggccaaacaaaatcaccacgttgtgcaacgtttctttgagaatcacgtttagaaagaaacatctgtacttaggctcatttggcatgaagtctttgaaatgcatccaattgcgctctataggttttccttccgtcatgtggtacacttgtataagaatttattcggcggaagcgggtttgagtgatcatcattgccgcgcttccataaattaaccacgaggtgaaaccatgacgaagatcaatctggtcgctcttggtggggtacgtgaaaacggaaaaaacatgtacgccgtcgaagttgacgaccaaatttttgtatgcgattttgggttaaaataccctgataatgagttacttggcattgatgttgtaatccctgattttagttatttaactgaaaatgctgatcggattgccgggatttttctgagccacggacatgcggatgcggttggtgccttaccatattttttggtggaacatcctgtgccagtttttggctcggaattgacgatcgcgatggccaaggtattcatgcaacatgatgctcaggctaaaaagttcaaagactttcatgtgattgatgagaagtcggtcattgattttggcgatgtgtctgtctccttctttaggacaacacatagtattcccggatcgttggggatcgatattgaaaccagcgaaggtcagattgtttataccggtgatttcaaatttgatcccagtgccacaccgatgtatcaaactgattgggcgcgcttggcacagattgggaataaaaaggtattggccttgctttcggattcggccaatgcggaatctccttatccaaatgctaatgaacatgaaatttatgatcacattaaagaaacattcgagtatcaggatggccggatcattgttgccggtgttgccagcaacattcagcgcattcagcaggttattaatgcggccgcttcgctcggacgacgcgtcgttttgaccggccgagatgttgaaaaagtagtcaaaactgcgattcgcatggactacatcaagctgccgaatgaggacgtccttgctaaaaccaaggaactcaaagcgcttgccccagaaaaaacggttattttggaaactggtcgtatgggtgaaccgatgaagtccttgcaacgcatggcgacttctcggcatcgtttgattcacattcatgaaggtgatttagtctttattacgaccaccatcgcccatgccatggaaaccatggcagcacgtacgaaagacatgatttatcgtgctggcggagatgtgaaagtgcttggggatgatattcattcatctggccatgcctacaaaaacgatcttcagctcatgatcgacttgttaaaacctcaatatcttgtgccagtgcaaggcgaataccgtctgatggctgctcacgcggagattgcgcatgaagccggtatcccaactgccaatatctttattgttggaatgggcgacattttacgttatgagaaaggtaaaatgaccgcatcgggtcatgtcaatgcaggtaacaccatgattgacgggatcggtgtcggtgatattggcaatatcgttttacgagatcgtaaaatgcttgcggaagacggcattttcattgcagttgtgacgattgatcgcaagaaaaaacgcgtcgtatcaaagccgaaagtcacgagtcgcggattcgtttatctgaagaccagtcgtgatctgcttgccgaaagcggcacactagtgactgatacggtccaaaagaacttggacaacaaagaattcgactggacacatttgaagcaggatgtccgcgataaacttagtcgttttctgtttgaacagacgaaacgccgcccagttatcctgccggtcattatggaagttaatcaaaatagcgccaagcgccaataatcaaaaagaaaattcggatcaccatttccggattttttatttttgcagtgatgacacgctttctacagcacgacaggagggttcttatggcaaaaatggtttcattaccggataatgaaaaacgtcattttgacatcggcgagcaggctttgcagaaaggcaattatgcttcggcagcggctcattttgaaaaggcctatgaagcagatcaatcttatgcaattgcccaaccgttggccgcaagtttgaatggcttgaagcagtttcacgaaagcttaaatgtgatgttgccacactatcaagctttcatgcagacagacgcagacgttcagttaatgttggatgcttggttagggacactcaattttgtcatggcacgtggcatgttgcgccattttgatgcggtgcggcgcgctacttttgaccgacaaattgacgctgccgaggcacttgctttaagtagccatggtgaacagattgcttcattggtgcgaaaaatcagccatctcggcggcttttcgcggcaggagcagcaagatttgttcagccaaattggcattttgccaaaagcggcgttagttgaagcagctgtgcctaatttggccgatcaaacggttcctgttgcgatgcgcgtgtctttgctagatttgttgacaagtatcagttataaccaacctgtcagatatcaggcatatgaccgcattgaaacccttgtgccaaatgagttgcctggaatggcggaggaaaaaagcggaccggccattttgacgcagttgcaagctgccttgggcgatgatgatcaggaactagggacggcattggttcagatggcgcgggtgcaaattgcctttctctatcccgatattgaccgtctgattccagatccagctgcattcgtccaagcttatttggatcatcatcaaggcaaaagcacggtatttgatcaactttttgcatggcagaccgccgaaacggcaaaattgtcggaacaggcgtaacgatacgttttcactgtaaatgaaagaaacttgacgctatctgtttacaaagtgaaattgaccatgtatactcattgctggaattcatttccagcgtagatatttgttttggtatttacgctcaaatgtagtacacttaaacgtaaaggattatcagggtacacaaggtatcctgtattcttacgaaaaatacaggaggttcgttttttcatggctgaaaaagaacactatgaacgcacaaagccccacgtaaacattggtacgatcgggcacgttgaccacggtaagactactttgaccgcggctatcactaaggtattgtcagaaaagggccttgccaaagcgcaagactacgcttctatcgatgctgctccagaagaaaaggaacgtggcatcacaatcaacaccgcccacgttgaatatgaaaccgaaaagcgccactacgcacatattgatgcgccagggcatgctgactacgttaagaacatgatcaccggtgctgcacagatggatggtgcgatcttggttgttgcggcaactgatggcccaatgccacagacccgtgagcatatcttgttggctcgtcaggtcggcgttgattacatcgttgttttcctgaacaagacagacttggttgacgatccagaattgatcgacttggttgaaatggaagtccgggaactgctcagcgaatacgattatcctggtgatgatattcctgttatccgtggttctgctctgaaggcccttgaaggcgatccagaacaggaaaaggttatcatggaattgatggataccatcgatgaatatatcccaacacctgttcgtgaaacagacaagcctttcttgatgcctgttgaagatgtcttcaccatcactggtcgtggtacagttgcttctggccgtatcgatcgtgggacggttaagattggtgacgaagttgaaatcatcggcttgaagccagatgttatcaagtctaccgttactggtcttgaaatgttccgtaagaccttggatcttggtgaagccggcgataacgttggtgtcttgcttcgtggtgttaaccgcgaacaagttgaacgtggccaagttttggcaaagccaggttcaatccaattgcacaacaagttcaagggtgaagtttatatcttgacaaaagaagaaggtggccgtcatacgccattcttctcaaactatcgtccgcagttctacttccacaccactgatgttaccggtgtgattgaattgccagatggcgttgaaatggttatgcctggcgataacgttactttcgaagttgacctgattgctccggttgctatcgaaaaaggtaccaagttcaccgtccgtgaaggcggccgtactgttggtgccggcgttgtttccgaaatccttgactaatttctgaatatacgcatgaacccgcaagcttgcttgcgggttttttcgtggtgtggagagagtggacaataatttcctcgtaatattttttgattcattaaacgccgaatagtcgtaggaaggtgctgggttaagaactacttgccgtgccaaactccgcaatctccggccagctggggctggaacgctgtgacggcgcttcgagcccgcaaagcccgcggtctcgaagtcgcctaacaacatcagctccaaggaccgtcgctgtgttgtttgcacggctgagccccatctggcctacgattgctccgccttggcactacggtctttaaaatcgaaataaataatccatgagaaggcaaaagcgaacaatttcccaataagcggaagattgttcgcttttaatagctgactaagaattatgacccagccacttttaacactatcaatgatcaaagagaccatataagcaaagcaaggatctttacgcttctttgctcacactttgaacctgaaagcagaagttaaaatttttatgcagaaactttaatttcgcttggctgtgctaataagatctgcgttttatccggctcgattttatcagctcccagaatggttttgccaatagactgcgctcggatgcggccgctgctaggattcttgatgctgacgatatcggagcaaatgtctgcatcaatattgttgctgtattcaaaaaccaaatctgaatgaagcagcgcatagttcttcatcgttaaatgatcgatataacacagtccctgattgctttcgattgtacagttgatgagcgtcaggtttttagcgttccaaccaaggtaattaccactgatagttgagtcgtatatggtgacattttcacagttccaaaatgcatctttagcaacaagggtagaatgatggatctcaacatttttggcaccatcaaaggcttaatcaccaatcagatcgagatagtcggcgacgatattcgtgctgttcatgccgaaatagttgccgcttgcttgcacatgatcgaggcttatgtgatcacagttccacaaactctcacttgcgtcggagaagtgaacgttttttaggcggatatcttgattgcggcgaaaagttttcggcgcctggatcgcactgtccgaaatagcgatgtcaaccgtataccagatacctgaccgtgccatggtttcaaagatggtgttagacactgcaatgtgctggctgaaccaaaggggatatttgcactggaaagttgactgatttaacttgatgtgtcggcattttttcagaggagactcgccttttccaaaagctgtaccaatgatggtcgcatgtttctgaccaaataagggacgttcaccgtggaaaaatcggttgttgtaagtcaccattataggttgcttctttctttgtatttccaaaaaatgatattgcgcattcaacatattaccgagccgccaatgcattgacctaaattttcacgctatgatgctgctgagaagttcagtagcctcaccagataaataaacggtatttgattcggccaaattttccatagaaacttgggacgcattgatgacgatcttggggcagcttacctgaaaactggtggcggggtaacgcgtgccaatgattaataacaggtcggcttttgctagcatttgctgcccatgccgaatttcgtctggataagttgccaagtgtcttaaaacaaaatcgggtaaaatcaatcctccgcagttaggacatgtcgggacggcagaagttgacgttttttgccagtcacaggggcgatgacaaatcgtgcagtgattacgtcggacatcgccccagtattccgcaagattgcgggttccggctttttgatgtagatagtcaacattcattgtcactacaccaagcagtttcttagcctgttcgagtttaactaacgcttcatgggccttattgggacgtgccttgggttgacagaaagtctgtctgtatagctggtaaaaagtgtgcggatcggcgattgcttctgttggatcaagaaaacgaaatacgtcaccagcaaacttgtgtgatttgtgtaagatttgatcaataccatctaaatcaggaatccctgattcagtcgagataccggcaccagtaaatgcaacgatttggtgatgttggcgtataagagttgctgcctgttgcaaacgttgcttttgtttcatgacactcatctggtttcaaaaacgcgacgcgcatcagttaaaccatttagtacccggggaaaaccaatataaggaatgcattgaatcatggtttcgacaatctcagttttggtcaaaccgacattgagtgcgccattgagatggacctgcagttggtcggcggtatcaccttggatgagcagcgcggtcacagtaatcatttcccgctgctttagatccaacccgggacgattgtaaatgtcgctaaaagcaaactccaaaatatacttaccgacatcaggcgcaatgtctgctagcgaatgcatgacgttagcagcggcagcaccatcaaccttggcaagcgtctcctgaccattttctaatcgtgttttgtctgacatattcatgacctctttcatttaggataccttcaccctaaatgctggagttaactccatgtcaatcacttttttaaattttctgccatcaatttggtttttagctgatagtaggtggcaattttattttccaaaaaagcgatatgtgcatcaatctcctgtcgttgtgccgttaatcggtttttttgcgtgaagagcaactgaagacgttcgtcaatcgtgctattgccttgataccgtaagcgggcatatgttttgatttccttaattggcatgccagttgcttttagccgcttgatgaatgcaatccagcgttgatcggcttctgagtatgtccggcgattattttgatcgcgagcgggaataattagacgctccttttcgtagtatcttaacgtgtcaattgatagtgaaaccatttttgaaaacttgccaatcgggtaccccatcaatgaagccttctttctttgatcatgttgggttgtatgatgagactttctgtataattagtcaacacttataaaaagcccgagcgttttaatcgccaaattaaaattattgttatatgataaaatttcgaaaagggggccattcatttggcaaaatctacaacttggcggatgatcgcatttttctggcaccaactcgcggatatgaagcgcaaattattacgtattattgtggccttggttggtgtggccgtggcttcatacctggttccgcgcttaacgcagtatgtgattgatcaagttattccaaaacgcgccatgggatcgctgattgggacgatcgcattagcgttattgctgacggcggtggcgggtttgctaagtggactcagcacatattggatcggacaggttagtttaagcgcgatcgcccgtatgcgtgacgctttatttcggcatacgttgggacttgacatgcattattttgaaacaagtaaaaccggggatttaatggtggttttaaccagtgatgtcaacaccttgcagcgtttaatctcaagcaacaccttgggcctgttcggaagtatgctgagcttttttgtcgtgctggtgttgatgctgattcaaaactggcagctcacggcgctgattttgcttacgtttcctgttttgttcgttttgaataatatttttgtgcgccgaattcgcgctgcttatcggcgggtgcggaccagttcgggtgtgatgaataaccaaattcaacaagctttgacgagcattgggcttatcaagagtttcacaactgaaaaagcaaccgcgaatacctttgaaaacgttaatgagcagaaccgcgataatcaactgacagcaacacgtcttggagcaactttttcgccgatcactgatttcgttaactatcttggtacggcgatcattttaggatttggtgcatttcaggtaatgcatgggcaattcacagtcgggctaattgtcgcctatacagcttatctgggtattcttcaagcaccgattcgccaagtgaccggcttgattcaacaattgcagcaagcaacggtttcttttgagcggattgaaacactgcaggcggcggtgccgcgggtggtatctccgccaaatgcgatcaagttagcgcgttttcatgaccgcattcaattcgatcgcgtcggctttagctatgatccgtcagtacctgtgcttaagaatattgatttttcacttgctaaagaacaggtgattgcattggtcggatcttcaggtgcagggaagacgaccattacgaacttgctggatcgattttatgatccgacagaaggaaaaattacgcttgatggggtcgatcttcgccaagctgacttagagagcttgcggcaacagattgtgattgtttcgcaagatgtgattctattagatggtacgatcaaggagaatcttgaatacggtacaccaaatgctagtgaagcggctatttggcaagccgccgaagccgccaacattgcaacgtttattcgcgaattgcctgatggtcttgccactcaagttggtgaacgggggattcgtttatcaggcggtcaaaagcagcgaattgccattgctagagtctttttgaaaaatgcgccaattgttattttggatgaagccacggctgccctagacaatgagtcagagcgatttgtgcaggctagttttgatcggttgatggcggatcgtacgtcattagtgatcgcccaccgtctgtcaaccgtccggcatgcggacaatattctcgtactggaacatggcgagattgtcgaatctggtacgcatgaccaactgatggcgcaaaacggtcgttataaagaactttatgatttgcaatttacttgataattgcagttagctggaaagcttaaaaatcggaatctatcgcttcaaagctctcagggcgggggaatgtgaaaaaaagcgacgctgatgtcgccttttttggccacaacatttacattcaagtgggtttcgggtatcatacattaagtatgcaatgtgaaattgcgagactaattgtcggaggtacagcatgtctgcaaaatgggaaaaaaagggcaccaatgatggtgagctcacctttgaaatcgatttaccacaaattcaacaaggtttagaccaagcgtttcaacgtgttcgcaagaacttgacggttcctgggttccgtaaaggcaaagttagccgcaccgtgttcaaacggatgtatggcgacgctgcactttatgaagatgctttgaacatcttgctgccagacgcttatgaagcagccgttaaggaatccggtattgatccggttgaccagccgcaaatcaacgttgattctatggacgaaggcaaaccttgggtcatcaaggcaaccgttacggttaagccagaagtcacacttggccagtataagggtcttgaagtgccaaagcaggacgttgaagtttctgcaaaggatattgacgctgaattggaaaagcgtcgcgaacagcaggctgaactcgttgttaaagacgacaaagcagctgaaaatggcgataccgttgtgatcgactatgtcgggacaattgacgggacggaatttgacggcggctcttccaagaactatagcttggaattagggtcaaactcattcattcctggctttgaagaacaacttgttggtcacaaatctggtgatgaagtgaccgttaatgtcaccttcccagaagactacaaggcagctgatttagctggtaaagcagccgaattcaagaccacgatccatgaagtcaaagttaaggaattgcctgcattggatgacgactttgcgaaggatcttgatgatgatgttgatacccttgatgaattgaaagcaaaaatcaagaaggaattgaccgatcagcgtgaggaagctgcaaagaatgccgttcaggaagctgccatcaaggaagctactgacaatgcgacgatcaaagaagtgccaaatgcgatgatcgagcaagaagtgcataatcagatggatcaatatcttggcaacatgcaacgccaagggatctcaccaaaaatgtactatcaattaactggtacatcagaggatgatttgcacaagcagtttgaggctgatgcagctacgcgtgttcggacaaacttagtccttgaagccatcgtgaaggccgaagatattcagccaaccgaagaccaagtgaacgaagaagtcaaaaacttggcttctgaatacaacatggacgaaaaggccgttcgtaaggctttgagtgaagatatgctcaaacatgatattggtgtcaaacaagccattgatatcatcacggacagtgcaaaagaagtcgaatcagctaaagatgatgctgacaaagaagcttctgacgccaaggctgacaaatagtttgccgtttccacgtaaaagagacgatccccgatcgtctcttttgttgtatgaacgcgtttttagcgtatacttgacgttattcttttagcagaaagaaaggcaagttatttgacaaaacggtgggtgtgcttccgctagtcggcacttgacgcttctgttagaatgaaggtatcaagaaagggttgaatcagatgtttgacaacgtcgaaacgacgggtccagttacttgttctttttgtggcaagtcacaggatcaagtgaagaaaatcgttgctggccctggggtttatatttgtaatgaatgcattgacctctgcaaagagatcattgatgaagaatttaaagaagaagcctatcagaatctgcttgaagtgcctaagccagtcgagatcatgaagacgctcaatgagtatgtcattggtcaagatgccgcgaagaaagctttgtcggttgcggtttataatcattataagcgagttaaccaaatgcagactgcaacgaaagatgacaccgaactgcagaaaagtaatattgcgttgatcgggccgaccggttccggtaagactttccttgcccagacattggccaaaattttgaacgtgccatttgcaattgccgatgccaccacactgaccgaggctggttatgtgggggaagatgttgaaaacatcttgcttaaattgcttcaaaatgcagactatgatgttgagcgtgctgaaaaagggatcgtctatattgacgaaatcgataagatcgctaagaaggcagaaaatgtttccattacccgtgatgtttcgggtgaaggggttcagcaagccttattgaagatcttagaaggcacgattgccaacgtaccgccgcagggtggccgaaagcatccgcagcaagagttcatccagatcgataccactaacattctctttattgttggcggtgcttttgatggtatcgaaaatatcgtcaagaaccggattggtgaaaagacgatcgggtttggaacggattcaaacgagcaagttgatccggataagtcactgatgcagcaaattattccagaagatttgatgcaatttgggattattcctgaattcattggccgtattccgattttagccgcgcttgagaagctgaatgaagacgatctggtacggattttgaccgagccgaagaacgccttggtcaagcagtatcaaaagctgctgagcttggatgataccgacttggaattcaccccgaatgctttaaaggcgattgcccatcaggcaattgtgcgcgacactggcgcccgtggtttgcggtccattatggaagccatcatgcaggataccatgtttgacttaccaagccgcagtgatgttgacaaagttgtcgtgaccaagtcagctgttgaaggtaaggctaagccacaactggtcttaaccaagggccgtgaagcttcttaaaacgcaactgtcatgaaagcatcaagcgaaaagcttggtgctttttttgactattgaaaaattcttttgaggttagccacggccgtgtttgcggataaggtgtcacccgaatcacgaccggtttctccggcgaggctgcgtaaaatatgctaaactatttgaagcggtgttgtgtttagacatcacgttgaggtaaagccaagaggaggccgtttgagatggacgtgcatgacgtcaaattaactattagtgcggttgcggccgctcagtatcccgaggacggtcatccagagatcgcttttttgggccgcagtaatgtcggcaagtcatcactgatcaataaactgattcagcgcaaggccatggcacgcacttctggtgtgccaggtaaaacgcagacattgaatttctatgatcttgatagtcgactcttttttgttgatgtacccggatatggatatgctaaggtcagcaaaaccgcacgagcgaagttcgccgccatgattgagacttatctgacgacgcggcaaccattgcgcggtgttgttttgctggtcgacagtcggcatgagcctactgctgatgacatcagtatgtatcagtatttaaaatattatcagctcagaacactggtggtggccaccaaaattgataagacgccaaaaagtaaacggctgcatgtgtccaaacagatcaaacagcgacttgatttgaatcagaccgacgatgtgattctattttcggcaacaactggtgaaggttatgaggctgtctggtcttggcttgaacaaacggctggcttggaggaaagataaagcatgaatttcaatgactatcagcaaaaagcaaatcgcaccttagctggcaatgaacacgttttgactaacctgtcattagggttggcaagtgaaagcggcgaagcgatcgatttaatcaagaaatatacatttcagggacaggatcttgataaagtcaagctgcaacatgagctaggcgatgtgttgtggtatttatcacagattgctttgtgggcagacattgattttgatgatgttgcaacaagtaaccttcaggaattggcgaaacgctacccacaagccaaaaaataatcggtttctaggtatgaaaaaagcgaagtgcgtgggcacttcgctatttctttgcttctttttctgttttttctttggctttcttggccaacttgtcgtggtgttttggatctggcccggttgcgttctccttatcaccaggcagactggcaaacttatcgaacatgtcattcaggttggtttgtgtgttgattttcagtgccatgcacgccacccctttccttgctgaaagtatagcatcaacactggggcgcgtctaggtaagtcgcccgaacaaaaaaatctggaaaaatatgaatgcatattgcataaaaatcaatttgagtgtatagtacactcttgtaatcaaggagggtattatgaagcatttgagacgctggttgatcgctttagtcgctgtttttgcggctgttgtgacattgaatatgcaaacggtccatgctgatgacagcttggccaaggttcaacaaaaaggtacgttggtgatgggcacgagccctgattatgcgccgtatgaatttttagtcaacaagaatggcaagaatcaagttgttggcatggatgttgaagttgcgcgtaagattgccaaggatctgggtgtcaagctggtcattaaacagatgaactttaactcacttctggtcgccttgcaaacgggtaaggtcgatatggtgttggcggcgatgtcaccgacgaatgcccgacggaagtcagttgacttttcaaatacgtactacaagtctggacaagacattttggtcaacaaaacggatgctaagatctacaaagatcataaaagttttgcgaacaagaaagtcggcgtccagaatggcagcttgcaagagacgttagcgaaaacacagatgaagacgagttccacattgggcttgactaaggtcaccgacctgattttggcgttgaagacacataaggtagctggtgttgtcgctgaaggtgcggtagcgaaggcttacacgtcaaatgatgattcgttagttgagattcccggtcacttcaacttatcaagcgacacagtcggtacggcgatagggtttgctaagaactctgattcattagtggcagccgccaacaagagcttggcagagattaagcaaaaaggtttaattaaccagtatctcaaaactgctggcagttacatgaaaaccaatactgaagataccagtatgatccattactggacctacttcctaaaaggggtcgagtatacgctgttgattagtgctatcggtgctttcttcggggttctactcggcacgatcttcgccttgctgcggttgagcaagaataaactgtcacatttaataggtgtgtcatacattgagttcgttcgtggcactccgctgatgattcaagtcatgtttgtctatttcggcatagggatcttcattgatattcctgcgctaatagcagggttgattgctgtttccttgaactcggcggcgtatgtggctgaaattatccgtagcgggatcgatagcattccagtggggcaaacagaagctgcccgttcgctcggtctgtcagagcggcagacgatgataagcgttgttttaccacaagcaatcaagaatatttggccagcgcttggtaacgaatttatctccttgattaaggaaagctcgattgtttccattatcggggttaccgatctgatttatcagttaacggttgtccaaaccgcgacatacaagggagttcaaccaatccttgtcgcgatggtcctctactttgttctgacattcgggctgtccaagctcttgagtcattttgaaaggaagatgaatcatgcagcataaacctttaatccaaatcaatcacctcaccaaaaagtttggcgacaatgttgttttgaacgatatcaccgaaaccattgacaaaggcgatgtgatcgttgttatcggtgcttccggtggtgggaaaagtaccttcctgcgtagcctgaatttactgaatcgaccaacaaaaggggaaattctttttgaaggtactgatttagttggtttgagcgagaaagagctggataatgtccgagaaaaaatgggaatggtgttccaaagttttaatttgttccccaatatgacagttttggaaaacattaaactcgcaccacttaaagtcaaagctgtgaccgatgaagaagcaaccaaaacagccaaagaaatcttggatcaagttggcttagccgaaaaggcggatgcttatccatccagtctttccggtggtcagcaacagcgtgtcgccattgctcgtgcattagcgatgcatcctgatgtcatgctgtttgatgaaccaaccagtgccttggatcctgaaatggttggcgaagttctgaaagttatgcaggatttggctaaaaccgggatgaccatggttgttgtgacccacgaaatgggcttcgcccgtagtgtggccgatgaagtatggtttatggatggcggcaaaatccttgaaaaggggacgccagaacaactgttcgaacacccgcaagaagaacggacacaagacttcctatccaagattcttgcccaataagcaaaaacacctcacccagcagctggtaagcggcactggttgaggtgtttttggtgtgaagtgaccattgctaaatgggggcagtcatgccatcacagatcaaagccgcttgcttgcaatctatttttagaatctttataatgttaggcgaacatttgttttataaggagattacgatggcctcagcacacattgaacacaagttatcgttgctgccagatctgcctggcagttatcaaatgaaggatatcaacggcaaaattatttatgtcggcaaggccaaaaacctgaaaaatcgggtgcggtcttatttcaagagttcacacgacggtaaagttgcggcgatggtgtcacaggtagcggattttgatttcattgtgacttcaactgacaaagaagcctttttgctcgaaattacgctgattcaaaaatatcagccgtattacaacattaagttgaaaaaagggactggctatccgtacattaaaattactcatgaacgcgatccgaagattgaaatcactggtactatccgtaaagatggcggttattactttgggccatacccaaatgtctatgcagcgcaagaaaccatgcattttatccagaaggtttatccattgcggcgctgtaacggctatcaaggcagaccgtgcttgtattatcacatgggtcagtgtctgggtgcctgcttccggactgttccggaaaaggaatacacggaccaaattgaacgtattaagcgcttcttgaatgggaacgttggcaaggctaaagccagtttgacggctaaaatggagcgggctgcgaaaaatcttcaatttgagcgagccgcagaaattcgggatcaactgcattatattgaacagacggtggagaagcaaaaaattatttcacacgacaatacaacgcgtgatttgttcaatttttatatggataagggctggatcagtatccaggtcttctttattcgtcaagcacgtttaatgaaacgtgagtcacgactttttccagtggtgaatactgccaaagaagaattcgaatcatttattttacagttttacagccgcaagaataatgtgaaaccacgcgaagttctcgtacctgctgggcttgataataaagtactggcagatatcctagagattccagttagaacgccacagcgcggtgaaaaacgggacttgatggccttggctgctaagaacagtcaaattaagcttgaagacaaattccgtctgatggaattggataatcgtaccacgattggcgcgatgaaagagctgatggccgctttgaacttgccaatggggcatgtggctgaggcattcgaccacagtcacattcaaggagctgatccggtgtcggcgatggtgcagtttgtggatggccagccagctaagaacaattatcgaaagtacaagttggatgctgacaagacgcataatggcgcagatgaggcggctaatacgcgcgaagtcattcgccggcgctatacccggttgttaaaggagcgtgcaccgttaccggatttgatcttgatggatggcggcgagattgaaatgaacgcagccaaggatgttttggaaaacgaactcaaccttgatattcccgtggcagggatggtcaaaaataataagcataaaacggcagcattgttatttggcaatgctgatcagctgattaatcttgatcctaagtcgcaaggcttttacctgcttgaacggattcaggatgaggtgcatcgttttgcgattaccttccatcggcagctgcacgccaagaactcgttagcctctcgattagaaggtatcaagggggtcggacccaagactcggctgaagctgttacggaaattcaagacgatcaataagattaaagaagctccccttgaagatattcaggagctgggtatttctaaaaaagttgcgcaggcattgaagctgtcgctgacggcagagccgacaccggcgcggcgggtttaatcaaatcgtaggagcgtttaggacatcgttcataaccattagtaagaacaaacaatcttgagatttaaagatctagtgccaaggcgaagcaatcgtaggccagatggggctcagccgtgcaaacaacacagcgacgggctctggagctgatgttgttaggcgacttcgagaccgcgggttttgcgggctcgaagcgccgtctccgctctagctacgcgtcgccaccccatctggccggagattgcggagtttggcacggcaagcgaattttttggctaggaatctaacgcaccacaagctcttatgtggaattccggttcggtctcacggcacaaaaaagcttggcgacattgatcgccaagctttttgcttacttatttgttttcttttgcgactggccgccagaagccgaggattaaggcggcaatgatggtcccaatcagaagcgacatgatgaagccaagtttctggttggttagcagcaaggcaacaacgccaccatgaggagcagggacgttgacgtgccataactgggtcaaaccgccagcaatagctgagccgatgactgagctgccaatgatatgcagcgggtcagtagcagcaaatgggatcgcgccttcagtgatgaaggtcaggccaagtgcatagttagaaagaccagcgttgcgttcttgcaaggtgaattttttcgggaagaaggttgaagcaaccgcaatggccaaaggtggaatcatgccaccaatcataaccgcggccatccaccgaccatctttaaagccggatgcttgatagacaccgatggcaaatgtataagcggctttgttgaaaggaccgcccatatcgatactcatcatggcggctagaatgacgccaatcagaatcgcattaccagtacccatgccttcaaggaagctgatcaatgcgccattgatagcggcgaaaatcgggttgatgatgaagaacatcagcagacccatgatggcaaggccgatgactggatagagcaggatcgtgcgcataccgtcaagtgaatgtggcattttgctgagcagcttcttcaagccaacgatcatccaaccagctgcgaacccggcaaccagaccgcctaagaagccagctgggttttgagccttcacaacggaggccgttgcaacggtggccatataaccaccgacgaacccaggcatcaacgcaggccgatcgccaattgattcagcaatgtaggccgctaaaacgggtactaagaagctaaaggcaaaggttcccaagttgttggtgaaggtgaaccacatcgatgtcttgcccagccattgttcgaggatgaacgagatcgccatgataatcccaccgccgacaacaaatggcaacatgtttgaaacaccattcatcaggtctttgtagatgcgattccataaagtgccgccagaagcttcttcactggccgcatcactgttatcggtgcctgcagcatgaaagacttggcctttgccttgaagcgtttcttcaatcaattcttcaggctttttaatgccgtcaatcaccggccgattgagcaactttttgccgttaaatcgatccattgctacctttttgtcggcagcgacaatgacaccagctgctcgattgatatcggaatcggtcagtttgtgcttaataccttcagagccatttgtttcgactttgatatcgacaccgagcttttccgctgtttctttcaaggctgcctcagccatgtaggtgtgggcaatccctgttgggcaagcagtgaccgctacgataaatggccgttcctggcgcttttctgccttgaactccgcttgcttgtcagctttttcttgttcttcctgagccttttccttggcttcttcagctttatctttagcctctttttcagcttgcgccttaccaaacaaggctaaaacatcatccggtgtcttcgcttgtttaagatctgccacgagcttcgggttgatgagcagggaagataatgctgcaagtgctgccagatgttcattgttcgcaccttcaggggcagcaatcatgaagaataagtgaaccggctggccgtctaaggcgttaaagtcaacgccctgatcgcttttggcgaaaagaacggttgctcgagtaaccgcactgtctttagcatgcggcattgcaatgccttcgccaatcccagtcgttgattcggcttcacgcttcagaatatcttggcgatactcgttttcgtcggtcacaataccttctgcatggtatttagcgaccatttcatcaatcacagcctctttggacgttcctttgaggtccatgatcatgacattttttagtagtaaatcacgaatgtccattttgtcctcctaaacttcagttatactaattgtttgtttcacttcagcgattttgtcagcggtggcaagatcttcagaaaaagcggtcgcggaaccgcaggcaatgccgactttaaagctttccaacgtgtcatgtgtctgcgcaaatgtgccggtaaaaccagctaacatactatcgcctgcgccgacggaattaaccgctggctgcttaggaacggtgccatgccaagcgtgatcttggtcgatcattaaggccccggcccccgccatggagatcaagacatgctgagcgccaagaccaagtaggcggcgaccagctttgatgatggcatctgtgcttgtatattctggatcgccgaacaatgctgctaattcatggtgattaggtttgacgacaaggggatggtcaggcaatgtgtcgagtaacgcttgaccagtggtgtcgatgacaaaatcagccttgtgggcatgaatcaccggaatcagatcccgatagaaagtgttaggcaagccttttggtaaactgccggacatgacgacgacatcgccggcttcaagtttgtctaatttgtttttgaaggcggcaatttcagcagcgtcaatggtaggaccgcttgcattgagttcagtttcggatgctgctttaagtttgacgttgattcgtgtatcaccagcagtttttgtgaagtcacaaggcatgtcaatcgcatcgagccgatcttggataaaggtaccggtaaaaccgcccaaaaagccccaagcagttgttggcaggcctaatgtttgcaaaattcgactcacattgatgcctttgccgcctggtaatttaacggcgtgcgtaagtcgattgacagcgccaagttcaagttccggtaactcgatcacataatcaatcgaagggttgagcgttactgaatagatcaagaatgaacctccttaatattttcaaatcgctgataactggttgggagtccttgtaatgaacttgtcaggatcgtggcatcggagatatcagcaaagcggacgaaactgacttgctcaaatttacttggatccgccagaatgacaggtttactggcttggtgaatggccaatcgcttgatcacagcttcttctggatcaggcgtagtaagaccaaactcaggatgaacgccgttagttccaataaaggcaacatcaaaccgataatggttcaaggcttcagccgtcgtggcgccaatcaacgctttggttgtgggcttgaccatgccgcccagcatgagtgtagagatttgataatcagctaacaaagaagcgttatcaactcccgttgtaatgactgtgacaccaatgtcggccaaaaaaggaattaattgtgctgttgtggttccagcatctaaaaagatcagatcatcgggctcaatctgacgaacggctgcctgcgcgatcgtttgcttggcgcgcaaattctgcgcagatttgctcgcgacatccggttcatcgccgaggccattgatgcgcttggcgccgccgtgaatgcgtttgagctcacctgctgcctctagctcgtccaagtcgcggcgaatcgtggattcagaagcatcaagagcagccataagtgccttagatttgatgacggtatgctgttgcaattgggcaagaatatattgccgacgttcttctgtaagcactttcgtttcacctcgttcttcattatactgatgaaaccgtcaaaagcaacctaaaacgtgcaaaaacattcaacaactgtcagtaccccgactgacgcggcatattggcaatgttttctaattcttgtgcatgaagggtgagtaccggcttgggacgtgttaaaatagttgaggtatgcgttacgctgtactgaaatataaacatcgcgtataatcaaatgacatgtttttctgaaaggagatcgccaatgtttgtcgatcaggttcaagtagaggttcaggcgggcaaaggcggcgacggtatggtcgcgttccggcgcgaaaaatttgtaccgtttggcggcccggccggcggtgacggcggtcatggcggcagcatcatcttatacgttgatgaaggtttgcgcacgttaatggatttccgttatcaacggcattttaaagcgtcagctggtggcaatggccaaggcaagcaaatgtatggccgcgctgctgaagatcggcggattgcagtgccggctggtacgacagttaccgatgctgacacaggcgaggttttaggcgatttaactgagccgggtcaaactttggttgttgctaaaggtggccgcggtggtcgcggtaatatgcactttgtttcgcccaaaaatacggcgccggaaatttccgaaaatggcgaaccgggcgagcatcgtttcatcaaattggaactgaaggtgcttgcggatgttgggttggttggttttccttctgtcggtaaatcgacactgttatcagttgtaacccaagccaagccaaaaattgcggcttatcaatttacgacgttagtacccaatcttggtatggttcaattagatgatggtaccgattttgtgatggctgatttgcccggtttgattgaaggggcttcacaaggtgtcggtcttggcatccaattcttgcggcatgttgaacgcactcgtgtgctactgcacctagttgagatggatcctgataatggacgcgagccgcttgatgattacgatcaaattcgtaaagaattaggggcttatgacgataacattttgaagcggcctgaactcgtggtcgcgaccaagatggacttgcccggcgcggctgaacgatttgctgattttaaggcagcgttacttgctcgtggcgtcgcggcggatcatatctttgaaatttctagtctgacgcatcgtggcgtgacgccactcatgcacaagacagccgaagtactcaaaacagcaccgcattttgagccgaaacaagcggcggttaaaacggctgattataagtatcaaccagagccggctttgaaagtaacccgcgatagtgacgggacgtttgtgctcactggtgacaagattgagcgggcgtttaaaatggccaatcttgatcatgaagatggcgcgatgcgctttgctcggcaattacgcagcatgggggttgatgatgctttgcgtgatgctggtgctgaaagcggcgatttagtcgccattgatgattttacatttgagttcgttgaatgatcttcggctgaacggctggggaagttatttttagacagaatggtggggccgcaattgaaacagacgcgtggacgaaagcgccggtacattcatggatttgatggtttaagaacaatcggggttattggtgttattttgtatcatttacgccccgagttgtttcggggcggatatttaggcgtaccgatcttcatggtcgtgtccggctatttgataacggatgggttgttgatcgaatttgaccgcaatcatcggattgattttaaaagtttttttattcgacgatttaaacgcctatatcctgggttaattaccgtcctctttgggacagcagcctatatcacgttattctcgcaaaacttgctgcataatttgcacatgatggtattgaccaatttactttatgtgtacaattggtggcagattttgaacgggcaatcctattttgctagatatgcaaatggggaatccccatttacgcatttgtggacgttgtcgattgaaggtcagtattatctcatttggccttttcttgtgttggcgctgttactattggttaagagccggcatcagattgcgaacattgtgctgattcttgcggctgccagtggcgcttggatggcaatcttgtatatgatgaccattgcccatgtacagccagcagcgtttgatccaagtcggctttattacggtactgatacccgtgccttctcaatcctattcggagcagcgctggcctttatttggccaagtggccggctttcgcaacacttaggtaaaaaatgggtgattgggcttgatcttctcggtactgccagctttctcggcttactagtcatggtcttcacaattgatgcccagagcagctttctttatgaaggcggaatggtattgttctcaatcgtgacaacgattttggtggcagtggtagcgcatccggcagctcattttgaccgattgttaagtaatccgttgttcagctatatcggcagccgtagttatggcttgtatttgtatcagtttcccgtcatgatcttttgggagaatcgttttcgtaacattgcggatcacccagtattatatccggtgattgaagtggtgctaattgttgttatcaccgaactttcttaccgcttcattgaacaaccggcggcacattttaattatcacaagacttgggcattcctaaagggcttagctaatcctaaagttcgtatggggaaaacgcgctgggttagttatgtggcgctgattatcttagctattggtagtgttggattagccaaagcgccttctgttaaagcagaaggtgacaactcgcctttagcacagcagttaaagaagcgtggtgtttccactaaagagaaagaaaagcggttggcagcaatgcgttccagtattgctgcacaaaagaaggctgacaagaataaagcggccgaagaatcaagttccaaggcgctagaagccaagtatgcttctcaagctaaaacgcatccagtcaatcgtgagtatgaacaatacggcttgacccagattcaattgcaacaggcacaagacattggactcactgctattggcgactctgtcatgcttgacggtgaaaatgggcttcaacagctgttccctaaagctgtgattgacgctgctgtttctcggcaaatgatcaatagtattgatttggtccgcagttacgctgaccgcggtgtgctgggcaatatcgttctgattgggttaggaactaacggcccattttcagatgatcagctagcgcaaatgatgcaagccatcggacctgatcggcaagtcttctggattaatgtacgcgtaccaacgcgcgcttggcagaatgatgttaatagcaaattagccgcagcccagaagcagtataagaatctgacggtgattgattggtatgacaagtctaatggtcatcctgattggttctacaacgacatggttcatatgaatccgaatggcaatccacaatatgcggcattagttgcgaaaacgattctggacaaggtgaaaaattaagcttccgacagatgattgattgcgttgatgagacaaatatgtcggttgatttcatgaggctgagcggcatcaagtcgctcagtttttttattagcggttgcagttagccgtccaccttcgtcttttttaaaccttgcaaatctcggcttaccaacattgaaaccgcgaaaatggcgaggaacttgtggtagactacaaagtgaagttcgacagaataggaagtatggtatggaaattcaatttttgggcacaggcgcagggtcgccttccaagtcccggaatgttagcagtttagccttaaaattacttgatgagcgtaatgaggtttggttgtttgatgccggggaaggcacacaacatcagattttacaaaccgctattcgaccacgaaaaattgccaaagtatttattactcacttgcatggggatcatatttttggcttgccagggtttttggccagtcgctccaaccaaggcggcacagatccgttgacgatttacgggccttctggcattgaggattttgtaaaaaccagtttgaaggtttctcaaagtcatctcagttacccattaaaatttgttttattacagcatccaggcgtggcttttgaagatcaaactttcaaagtcacttttgatcgcttggatcatcgaattacgagctttggttttcggatcgaagaaaaaccgcatcctggcgagttgttgattgataaggtacgtgccgctaaaattccttctggaccggtttatgcggctttgaaggccggcgaaactgtaaccttgccagatggccggatttttgacggccacgatttcattggccctgcgcaacctggcagaacggttgccattttcggggatacccgcatgtgcaatcgcgcgctgcctttagcagcaggcgctgatgtgttggttcacgaaagtacctttggaccggatgaaagccaattagctaagcagtattatcatgcgaccaatgtacaagcagcggcgttggctaaacgtgcaggtgtcgggcggctcttgctgaaccatatttcggcacgatatctgagtcccggggtagcgatgttggaaaaaacggcgcggcagatttttccaaatacgcatgttgtcaaagacttcgaggaaattaacattccatttcggagtaaacaatcggaacctgctgtcacagttaaatcataaagctcagcggtagcaagtgaatatcaaaacagaggaggaaatcatgatgaaccaacatccgacggtggttatttctggaggatcgtcaggcttaggcaaggcgattggacttgaggcagcaaagcaaggcgcaaccgttgtctttttggcgcggcggcgggagaaattacgtcaagcacaggcagaggccagcacgctttccggccgaccagcttatgctttccctgttgatgttgctgacccagttgcaattgaagcgaccgttgatcaaattcacgaaacggttgggccagttgatattctggtgaatgccgctgggtttggtcattttgaaacagccttcgataccgatatgcaggtagtagagcgcatgtttcgggtgaatgtgctggggatgatgtatctgacgaagttgctgggtcgcgatatggtcacgcgtcagcaaggacaaatcattaacattgcttcaatggctggaaaaatggcgacgcctaagtcagctatctactcagcaaccaaatttgcggtgcttgggtatagtaatggcttacgtcttgaattgaagccattcggtgttaaggtgaccacggttaatccgggaccaattgccacgaatttctttagcgaagccaatgcgttagactatttggctagcgtttcttggctggttttggatccagataaattagcgcggcgaattgtagcgacatttggtcgaccagttcgggaaatcaatgcaccgtggtttatgaatcttggcgcagatttttataccttgttcccgcatttgggcgattggttagctgctggtatgtttaataagaagtaaaggggtaggtcgtatgaagggtcaacaacgttttattattgggttagttctggcattgattttaattgtttttgccttgttgaatgggcaagacgtttcggttaatttcttcggtattcagctaaagtggccgttgatagtgattattgcggtttccgtgttgataggtgccgttgtgacctggttgatctcaaccagtgccgtttcgagtgctaaaaaacagattcgtgagttgcaacaacggatcacggagctgacaaaatccaataaaactgacaagccagcccctaagccagttcaagcaccaaaagaggaaccgtcaacggatgcgacggataccaaaaaatagacctttgaggattgaactgtcgtacctagctgtcaatagaggagcccgtgacaaaattctcagtcagacaaataaacaaataaaaggaacaatttttcgattgtacgattggaaaattgttcctttttgccttcacatagattatttaatgcgattttaaagaccgtagtgccaaaacggagcaatctaggccacctgaggctcagttgtgcaagcaacacagcgacgggcttcctacgatttttttaaatcatcatgaaatttaaaaaatagtttgaccttaactgaccaatgtcgtattgtgaaaatgaaaactataatgtaagacgatatttttcagggaggcatccgtattcatgaacccagataattttacgcaagccgttgccgaagcacttggcgcggcacaacaaattgcccaagttcgccgtcatcaagaaattgacatcccacatgtcatgaaaagcctggtgcagcctaatcaattggctgaacagatttatcgtgaagccggtgtgaatgtgcagggcttgaatgctgcgattgatgcggcactggaagcagagcctgtcgttgaaggcgctagcgcatacggacaaagcatgtcccaaaacctgtcgcagctactgacagatgccaacagcgtgaaggatgaatttggcgatacctatatttctacagaagcagtcttgctcgccctttatcaacaacgctacaacccgatcacccaattcttgttgaacgatgccaaggttgatgcaaagcgattacgacaggtgattgagaacctgcgcggtggtgaaaaagtaaccagcaaaaatgccgaagcctcttataagagtttggaaaagtacggtaccgatcttgtaaaagaagcgcgcagtggcaagatggatcccatcatcggacgtgatgaagaaattcgcgatgtcattcgtattttgagtcgcaaaactaaaaacaatccagttttgattggggaaccgggggtcggcaaaaccgccattgtagaaggtttagcccagcggatcgtcaaaaatgatgtgcctgacaatctgaagaataaaactatcatctcacttgatatgggaagtcttgttgccggcgcgaagtatcgcggtgagttcgaggaacgcttgaaggcggtcttaaaagaagtcaaaaagagtgaaggccaaatcattctttttattgatgaaattcacaatattgtcggtgctggtaaggcagaaggctccatggatgctggtaacttgctgaagccgatgctggcccgtggtgaattgcatctgatcggtgccacgacactggacgagtaccgggaaaacatcgagaaagacaaagcccttgagcgtcggttccaacgggtgctggttcaggaacctagtgttgaagatacgatcagtattttgcggggtctgaaggaacgattcgaaatttttcataaagttcggatccatgataccgcgttggtcgctgcagctactttgtccaatcggtatatcacggatcggtttttgcctgacaaggcgattgatttggtggacgaggcttgtgccacaattaacgtggaaatgaactcccgcccgactgagctggatgtggcagagcgcaaacagatgcagttggaaattgaacagcaagcactgaagaatgaaactgatcctgccagcaagaagcgattagcagatgctgacgctgaattggccaacttaaaagagaaaacaaataagctcaaggctcagtgggaagcagaaaagaaagatattcgtcaacttaacgagaagaagtcggcgattgataaagccaagcatgaattggaagatgcccaaagtcgctacgatcttgaaaccgccgcgcgtttgcaacatggcacgattcctcagttggaaaaagagctgcagacgatggaacacagcgatcgtccgcaatcttggctagttcaagaaagcgtgacagccaatgaaattgctgcggtgatttcgcgggaaaccggtattccagtagcaaagttggttgaaggtgaccgccagaagttattgcatttggcagataatctgcaccaacgtgtcattggccaaaatgaagccgtcagcgctgtctcggatgctgttttgcgatccagggccggtttacaagatccaagtcggccacttggcagcttcttgttccttggtcccactggggtcggcaaaacagaacttgctaaagcattggcagaagatttatttgattcagaaaaacacatggtgcgaattgatatgtccgaatacatggaaaaagccagtgtgtcgcgattagtcggggcggcccctggttatgtcggctacgaacaaggcggccagttgactgaagcagttcgccgcaacccatataccattgttttgttagacgaaattgaaaaagctaacccggacgttttcaatatcctcctacaagttttagatgacggtcgtttgacagatggtcagggacgtaccgtcgatttcaaaaatacgattatcatcatgacgtccaatttaggctccgagtacttgctggacggtgtgcaagaagacggcaccgttagccaacaagccaaggataatgtgcggcaattggtcggcaaagcctttaagcctgaatttttgaatcggattgatgatattatcatgttcaacccactatcattagcagatgttgaaaagatcgctgtgaaggatctcaagcaattaggcacgcggttggccgatcaacagatatcgcttgatatcacaccggcagcgcaggagtggttggcccataaagggtatgagccagcgtttggtgcccggccactgcagcggttaattacgagtgcggttgaaacgccgctggctaaagaattgattcgcgggactgtgatgccgggtcaagaagtcgtcatcacggttgcggacgatcagttgcaatttaaggcaaaaacagtaccggtcaaagcttaaaccggctggcaactgattttttctgtaaagacccttgccttgacgcgccttttcatgtatgattatcgttgctgtgacagatagcattctgtccacgcgtgatgatgattggacttgcattttgatcatcaaccgtataaagttgtttagaaatcttactaaaaaaggggttttccgctcatggcagttccagcacgcagaacgtcaaagaccaagaagcgtatgcgccgcggtcatatcaagttgaatgtgcctaacttgcaattcgacgcagcgaccggcgaataccgcatttcccaccacgtttcacctaagggttactacaagggtgcacaagtggttaagaagtccgacgataacgcaaatgcataatcaaaagccaacatcttaggtgttggctttttgtgtgtgagcgctcgccagcccgtttagaaaccggcgtgtaagtggccctgaacatgatgaccgcactgtggtcattgcgttcaaggtccttacacgcaggtttctgggctggcgagcgcgttatggtgaacggagtaagtttctgggcaggtgcacgcgttatggtgagcgtgagtacgagcagctagaagtcggaacataagcgaccttaccaatgaaggctgtactttgatcattgggtaaaatattagcatcaatcggtccacgaatggttatcaagtctagctcacatggtatactcttcttgaaagaggtggcagcatatggctgataacgaacaatttgccgattatctagggcaacttcaagaggcgcagtttccgcgctggactgatctgccccaatttgacttgtatatggatcaagtgatccagtatgtcaatgatattgtcacaccgctggggtttggcgagatcacatccacgatggtcaataattatgttaaaaagggggttattaaagccccgcttaagaaaaagtatcgtccagaacaattagccaatattttagtcattgcgatgctaaagccagtttttgcgttggatgctattgcggcaggtattcaattttcacttgccaatcggccggttgcgcaagcttacgatgcgtttattctcacttttagcagcgcaattgagcaggcaaattcggattttagcgatggtttaaccattagccgcgtcaataaaccagatatgacgacaacccagcatgccattgtgacaatggccattaatgctgttttacaaaaactgttagttgaaaaaatgattgatctggctgctgatgattcggaaaagaaagggaaaaaatgaaactaaccattctatcgacaagtgacacgcatggttttgtcttgccaactaattatgtgaaacgggatcaggatttgcctttttcattagccaaggccaaaacggtgcttgatgctcagaaggcagcagctgaaggaccagttgtgacgattgaaaatggcgattggcttcaaggatcaccactggcctattacgttgcgaagatcagcaagcagccagatcagttgacgcgactgtataacgaggttgggtatgatgccggcattatcggcaatcatgagtttaattacggcagcgactatttgcggcaagcgttgaagacattgacctatccaaccatcaacgctaatatcaccgaaaatggtcaaccagcatttggggcgccttatcaattgattgagcgctcaggggtcaaaattgccattctgggtttgacaacgaactacatcccacattgggaagcaccggcccatattgccggcttggcttttcaagatgtggtagcgactgccaagcactatgtcccattgttgcgtcaacaagctgacgttgtgattgttgcttatcatggcggttttgagcgtaacttgcagaccggtcagccgactgagccattaactggcgaaaatgtcggatatgcgctgacccaagtaccggggattgatgctttagtcacgggtcatcaacatcgacaattggccggattagttaacggtgtgccgatcacccagccaggttaccgcggggaagcgatcggtaagatcacacttgacttaaatcagacagcgagcggttaccaagttactgctagcaaagccgtgttagtcaaaacaggcggatcaattgcgagcccaaccattttgcagtcagcggctgatctgaatcaaactgttgaaacttggttagaccagccattagctcatgttgaaggggatatgcgcattcaggatccatttgctgcgcgggttcatgaggtgccgtacattgagtttattcaaaaagtacaaatggccagcaccgatactgacatttcgggcacagctttgtttaacaatgaagggcgagggtttggtgaaaccatcgacatgcgggatgtcgtcacgaattacatttatcccaacacgctagctgtgttgcggttaaccggcgctgatttaaaagcagctctggaacagtgtgccgaatatttttcgctagatgctgatggcaagttgacggtgacgccccgatttgagcggccaaaacctcagcattacaattatgacatgtatcagggcattgattatactttggatattcatcagcccgtgggcagtcgagtaactcggctgctttatcacggtgcgccagtacagcccactcagacttatgatgtggcggttaatcaataccgtgcggctggtggcggtaattttaaaatgtttggtcctgataaagtcatccgagaaaatcaaaaagatatgaccgaattgattgccgattatttgcaggaacacccattaatcaaggcaactgctgatcaaaactttaatgttttaccgtcaatgtgacagtgagtcatatttcgcttgtcaagcagcgaaggaacgcttatgctgttggtcgttattgaattgtgcatagcgaaaggattgttcggtttaatgaaaatttggaaatataccatggtcggcttattggcattcgtgctagcaggttgcggccaacaattaagcactaccaaaacctcatacgggcgtgacggactggtcgccattgttaaagggacggcccgcggtgtggatcgcgtcagttatacaagtgatgccggaaaaggcagtgtgccagtcaattcaggcacgtttgtggtcaatgtgcccgttagcgatgtggctcaaaaggtgaacctaaaagccggtagcatgcaaactaacgtcacggtgaaagctggtcaatcgctcggaacttatagcacgattgcggcaaagtttaatcaaatgctggcggtatccagtctacctaaagcggatcaagccaagctaaaacaggcacaggctgcaagtgccaatgctcaaaagaacgctgcgaccatgagtccaactgagaagatggcaatggctcagcaagcacagcaattgaagacactgatggctcaggccaatgccaataccaaagcctcccaactgccggcaacggcgaagacgggcattcattcaatcttaaaatcagcaagcggcgattatcgcgcaagtattgttgatggcaaggcaatggggtttgccgttgtggtaccattatcagttttgaaaaacagcaagaagatgcagacgtttgccactgacttcgggttactcacaacttcggtcggtgctgatgccaagtcagttttctcgcaatttaagaaattgacgaaggatgctaagtctaaaaacaatgcgacgaccattagcacaatcaagagtcacggcgtcaaaattgatgttggttattccaccacagcactttacctgtatgtgacaaaataagcttgcgtcactcattccaaaaacgtcagcacatgcaaagtgcccggttattgttagacatgccagtctagcaataatcgggcactttgacgtcattgacgatttaattaatgttctggtttttccgcaggttttgcaaaatgctgcatgattggcgggaagaagaataaaatgacaacgaagatcacactgataatcgcgcttgtcttcgggtcgtagctgccgccgctcaaggcgctgatcaggaagccgacaacttggccgaggatcacgccccagataatagtaggtagataacgcatggaatccctcttttctgtcgtcatcttaccacgaccacaagcgaattcaactgaaattgtgagtatttccggtataatagaagcgaggtggcaagatgacgtttacccaattacaggttcatagcaattataccttattacacagcccgttggcactgtcggatcttatcagcgcagcaaaatcacgcggttattcggccattgccttaacggacactaatgttgtttatggtttagtcgagttttatcgacaggcgaaagcggctggcttgaagccgttattaggcatgcagatcgcgattgatgatgccaaacttttagtgattgccaaaaataatcagggctaccatcagttacttaagatctccacgcagattatgctagcaacttcgccggtggcctttgcggacttattgcctttgacaggcttagtcgccatcaccttaccggattcaccattttcggcggcagttgctgctaacgatcacgacagagctgtcgcttttttacaggagcttgataataaacagccggaagcggtgtatgttggtctggatgaggctcatttagatacgccattgccggcatttgcgactagtcagcaacttcacctaatggcgttaggtaacgtactgtatcgtgatccgactgatgcttttacgcaaaaagtgatggcagcgattggtgatggtagtcagttgaattttcgtgacccagttttaaccgatgctgggccgtggtggttaaaaccgccagcagatgcaagtgcaccttttgttgctgctggactacaggcggcagttgacaacgcggctcagatagcggatcaaacggatgtgacgattacgttcaagcagccgcagctacctcattatcaaacgccagatcagcttgcgtctaaagattacctgaccaaactggctcaagaaggcctcgctaaccgttttcacgatcagccgattccgataacctatcagcagcgtttgcaatatgaactggatgtcattatcaaaatgggatttgctgattactttctggtggtttgggatgtgatgaattacgctcacaaggtcaatattatgactggggctgggcgaggatcagctgcgggctccttggtcagttacgcgctggctattacagaagtcgatccgattgcttatgatctgctgtttgaacggtttctgaatcctgctcgagcgcaaatgcctgatattgatttggacattcctgataaccgccgtggcgagctgattcaatatgtccatgacaaatatggccgaaatcacatggctcagattattacttttgggacgttcggcgcgaaacaggcgatcagagatgtggcacgcgttttcggcatgagtcagtttgaaagtaatacttggagcagagcaattccaaacttgttgcacatggatttaaaaacagcatacgatcagagtcagccgttgaaaaatttggtggccgattcaccaaaaaatcgcatgctgtttcaaaccgctttagcattggaggggttgccgcgacattattccacgcatgcagccgggattgtgctttctgaagaaccactaactgacaccgttgccttgcaacccagtggcgatggtcttgaacagacgcaggtacccaaagatgatgttgaagcccttggcctgcttaaaatggattttctgggtttgaaaaacctcaatattttagccgccgccagtcattttgtcacccgtgatactggccggacgtttgatccaaaacagattccgctgaatgatcaaccgacactcgctttgtttgcccgcggtgatactaacggcgtttttcaattcgagtctgctggtatcaaaaatgttttgcgcaaactgcggccaactgattttgaagatgttgtggctgtcaacgccttgtatcgtccaggtccaatggaaaacatcgacacgttcattgcccgcaaaaatgggcaagaaccgattgcttatcctgatccggccttggagaagattttgaaaccgacttatggtgtcttggtttatcaggagcaggtcatgcaggtggccagtgtcatgggcgggttcagtcttggcgaggcggatttgttgcggcgggccatgagtaagaagaaatcatcagtgctggcagccgaacaggataaattcattgaaggtgcggtcaagcaaggattccctgaggcgactgccaaaacggtttatgcttatattgatcgatttgcgaattacggcttcaatcgttctcacgcagttgcttatagtatggtcgcattttggttagcgtatttaaaagtgcatgatccagccgccttttttgcggcattgatgaatgctagtatgaataatttgccgaagctccggacttacgtacaagaagccaaagcgcgtcaggtagctttattaggtcctgacatcaacaccagcaatggtggctttaagttgagcgacgggaagattcgctttggacttttgtctgtcaaagggatgcgccgtgacttttccgaagccatttttaccgctcgtaaaaatggcccgtttaaagattttcgcgatttactacagcgcctcgagccgaagtggttaaaggcagataatttcaaaccattgattcttgccggtgcctttgatagctttgatgataaccgggcacagacaattgcgaacttagatgaattaatcaactcggttaaacttgctggcaatgatgttgggctattttcagtgctagcgcctaaaccgattgtggtgccggaaatgccggcaggcgaacggcttgaagaagaggctaatgttttaggcgtttacctttctggtcatccggttgacaaatatgcccctttgaaaacgcaatacacattagtcaatgtggtggatttagcagaaggtcgcacggttgatattttgcttctggttcgacacattaagcggatccggaccaaaactgggaagcctatggcgtttgtggatggacaggatgcgactggcaccgtttcgctgacggtttttcccaatctatatccaacattagaaaaaattgagaccgacatggtggtactagtgaacgggcgagttgaaaaacgcaatgacgacttgcaactcattgtgaaccggattcaagatgccgcaccgttacttgaggctttaccaaaagcacagttatttattcgcttggatgcggataatgttgacgcccggaccgatttactgaaaaaattgcaaactgcccatggaccaattccggttatcactgtcgacacgaccagcaaggagagtgttttgttagataagcgatactgggtcactgctgacaccagcttgatggctgatcttgaatcgcggtttggtgcggctaatgtggtgttgcgaaaacgacaagaagaatagagaaaattgtaaaatgttctcattttcagggactttgtttctgaaaagtggtaaactcaatgagtatttgtgatgggacaaatcgcaaaagaatatgcatgaggtgaaataatgaaacgcattggtattttgaccagtggcggggatgcgcctggcatgaacgccgcggtccgcgctgttgctcgcaaggcgatgcacgaaggccttgaagtatatggcatcaattatggatttgctgggttagttgccggcgacattttcaaaatgaatgaatcaactgtcggtgataagattcaacgcggcgggaccatgttatattccgcacgttatccacaatttgcgcaagaagaaggccagttgcgcggggtcgaacaattaaacaagtttggcatcgaggcgttggtcgtcatcggcggagacggttcttatcacggtgcactagctttgacgcgtcacggtttcaacaccattggcctgccaggaacgatcgacaacgatattccttacacggacttcacgattggctttgacactgccgttaatacagttgtggaagctgttgaccgtcttcgcgataccgcggcttcacatgaacgaacctttgtcattgaagtcatgggtcgtgaagctggggacattgccctttggtcgggcgtcgccggtggtgccgaggatgtcatcattccagaacacgactttgacgttaagaaaattgcgtcgaagttgcaaagttctcgtgaacgtggtcaaaagcatgcggtcattcttttggcagaaggcgtgatgcacgctgatcaatttgccaaggaattagccgcacatggcgatttccaattacgttcgacagttctgggacacattgttcgtggcggtgcaccgtccgcacgtgatcgcgttttggcttcacaaatgggttcatacgcggttgaacttttgttgcaaggcaaaggcgctttggctgtcggcattgagaataacaagatcacggcacatgatgttcggaccttgtttgatgccaagcatcacgcagaactttcgctctacaccttagcggaagagttaacattttaatctcgtaaacaaacgacattaacgtctgtttaaataatttcaaggagcgatttcacttatgaaaaaaaccaagatcgtcagcacgcttggacctgcaagtaacaccactgatatcatcgttaagttgattgaagcgggtgccaacgttttccgtttcaatttctcacatggtgatcatgaagagcatttggcacggatgaacatggttcacgaagctgaaaagatcacgggtaagaccgttggtatcatgctggatacgaagggtgccgaaattcggacaactcttgaagataccccgaatggtaagatcgattttcacaccggtgacaaagttcgcatctccatggatgcaagtctgaaaggcaccaaggaaaaagttgctgttacctatcctggcctttatgatgacactcacgttggcggccatgttttgtttgatgatggcttgattgacatgaagatcaccgaaaaggacgaaaagaaccgtgaactcgttaccgttgttcaaaacgacggtgtccttggtggtaagaagggtgtcaacgctcctggtgttgccatcaacttgcctgggattacggaaaaagactccgatgacattcgtttcggcttggacaacgggatcaacttcattgctgcttcctttgttcgtaagcctcaagacgttttagacattcgtgaactccttgaagaaaagaacgcacttaatgttcagatcttccctaagatcgaatcacaagaaggcatcgacaacattgatgacatcttgaaggtttccgatggcttaatggttgctcgtggcgacatgggtgttgaaattccatttgaacatgttccgatcgttcaaaagcgcttgatcaagaagtgcaactctttgggtaagccggttatcacggctacacaaatgttggattccatgcaagaaaacccacgtcctacccgtgccgaagtaaacgacgttgccaatgccgtctttgatggcaccgatgcaacgatgctttctggcgaatctgctaatggtgactatccggttgaatccgttgctgcaatggctcggattgacgaatacaccgaagcagcgatgatggatcaggatgccttcgcattgaaggaatacagtaacaagaacgtcaccgaagctgttggccaaagtgttgcacacacggctcgcaacttaggggttaagaccattgttgctgcgaccgaatccggctacactgcccgcatgatttccaagtatcgtccgaaggctgacattcttgccattaccttcagcgaaaagacccaacgcggcctgatggtcaactggggcgtttacccaatcattgctgaaaagcctgctaacaccgatgctatgttcgacttggcaaccaagaaggcccaagaccttggctttgctaaggaaggcgatctgatcttgatcactgccggtgttcctgttggtgaatctggtacaaccaacgtaatgaaggttcaactcattggctccaagctggttcaaggctcaggtgtcggcgacgaatccacgattggtaaggcagtcatcgcaagcaacgctcaagaagctgctgctaagatgcaaaagggtgacattctggttgttaagacgactgacaaagattacttgccagcaatcgaaaaagcagctgccttggttgttgaaaccggtggcttgaccagtcacgcagctgttgttggtattgctatgggtatcccagttgttgttggtgctgaaaatgctaccagcgtcatctccgatggccagatcattactgttgactcccgtcgtgggatcatctacaaaggtgctaccaacgccctttaatcttcaaaatgacctgttaaaggttaggaaaaactctcaaggaaacttgggagttttttcggctctacgtcaactggtgttgaagaataaatttatcatttgaggcggttctccatttggggagccgtctttgtcatgttatgccgtgatttggtagattcgtttaaagaagttcagctgattcttgaagccaaaacaggatcgtttgagtgacttgatgaggcggttaaccccttcgatcggaccgttggaataagggctggtgacagcggcgagaacagcgactttgtgtcgcttaagcgtcgcgatcgtcatgtccattgccgtaccgtttggctcgtaagtagctaacaggtttgccagttccgtgggatgtttcttcaccatcaaggcatcatgaagcgctaagtaggtctcgtaggtttgcttgagcttgggctcagtatcaagtgcgatatcgatggcctcctgttgcgtgacgtattcattcaaaccaaacaggaactgtttgtgtttagcgtcaggcgcagtttgatgaaaaagccgccagtttgtcttcatgatcttataaggacggctgtgtttgtcatcaagctgtttgagcgcttggacgcgtacctgatcaagggcacgagccgcaagttgaatgatatggaaccgatcaatgacgacttgggccttggggaaaacctcatgaataatcgtctgataagctgcattcatgtccatggtgaccgtctggacccgagtgcgttcagcgagtgaataatgagcgatgaagaagtttttaatcgtgcggttgaatcgatcaccaagcaaggctatcagatgatgtgaatcggcatcaagacagataaacgacatcatgccatgagtagaacggaactcatcaaagcagagtcgcgtgggcagccggcgagccggtcggagtttgagattttggtcaatgatccgttgaaccgaggaagctgagattccgataatacgggcgatggttttgactggcaaccgttcatgcgctaacttcatgattcgctctgtcatgtgagtggcgatcgtgtggttgggttgcacgagtggcgtcttggcactgactgtgtggtaacagttataacagcgccatcgttgcttgtgcaagtcaatgactgtcggcatttcaaccccattgaggacgcgcacgtgggccgtataaaacccgttagggtgcaaggcctcaaagccacacagtgggcaccgggttaaccggtaagtcagctcggcatcaatcacatgatactggcggcgacgtaccccgttgccgcgatattcatgacgaacaaaagcaactttgatattatggtctggtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttctcaacaccagaaagtgtagacccgttttttcttccaaaaaaacactaccgttgcctgttttgagcaacttactgataaatgtatgagcagaggtcgtcaggtgcgtgcgagtggcttataataagaaacagtatgcaatctcgtaagcgataacgctggcagtttggtcagcatcatgatggagggaacacttgtggagagttggctttttttactaggtattttagcaattgcaattgtcggcaaaaataaaagcctgataattggggtcagtgctgtgatggttctcaagctgatcccgcaaactcaaaactttttgaaattgcttcagacgcaagggatcaattggggcgtgactgtgatttcagccgctatcatggtgccaattgcaaccggtgagatcggctttaaagagcttcttaatgtcattaaaagtccggctggctggattgcgatcgggtgcggcgttttagtcgctgttttgtcggcaaagggtgtcggtctgctggcaatgagcccggaaatgactgtggcattggtttttggcacaattattggcgtcgtgttcttaaagggcattgcggctggaccggtgatcgccagtggcctcacctatgttatcttgaccgtttttaatcttgttcctggacattaatgaccggcaactatggcgctggtttaaggagaaaaataaatgaattttaatggcagtattgtcaccgcacaagtgacggatcacaatgacacggaagtctttgctcagcatgatggcgtcactttggccattgatcgcagtgagttggctgaacttccagaagttggcagtgatgttgagggttttgcctatgaaaataagcaagggcaggctcgtttaaccacaaaagttccgacagttggccgcgaccattacgcttttgcgaaagtagtcgaagtgcgtaaggatcttggggtatttgtgaacattggcttaccagacaaagatattgtggtcagtgaagaccagttacctgaaatcagccgtttatggccgcaaaaaggcgatcaattaatggttgccttaacagtcgacaaaaaagaccggatgtggggcaatctggctgatgaaagtatcatccacgcggttgcaaatcgcgcgaagcctgaacagatgaatgctgatgttactgccacggcttatcggttgaagatggctggaacgcgtgtcttgaccgatgatttttatttgggttttatccatccaagtgagcgcgatgctgaaccgcgacttgggcaaattttgcatgctcgcgtgatcggggttagtgccaatggcgagctgaatttgtcgctaaaaccacgtgcctatcaggccatcggtgatgatgctggcatgattttggcagttttgcagcatgatccttcaggaaaaattgcttatacggataagagtgatcctgaagcaattaagcaaacctttggcatcagtaaaggcgcctttaagcgcgcactgggccatttgttgaaggctggcttagtgaaagaggaagctgggtatacgattttgacggccgcagccaaggcgtctcgggagtaacatcatgcatgggttgatcgcggattttattcattatctaaatgttgaacgcggattggcaaaagccacccaaactagctatcagcaggatttgatcactttttcggcttggctagcggcccgaaaaagaaggacatttcccgaggagttcggtaccatccagtcctttttaaaggagcagaatgccaccaaggcacctgcttcagttagccgcatgatttctgctttacgcaagttttatcggtttttactgcgtgaaggggcaatttcagctgatccaatgaccaagattgacaccccaaaacgtgcccaacatttaccagcaacgttgtcgagtcaagaagtcgatgctttgatggccaaaccagataccgacaagccattgggattacgtgatcgcgctatttttgagttgatgtatgctactgggttacgggtttcagaagttgttgatttacgtcttgatcaattgcatttggcaatgaatctacttcaagtgactggtaaaggggacaaagaacgactggttcccattagtccgcaagccacacaatgggtggatcgctatctgcaagaggccagacccaaattactcaaacgagtacaacctaaaaacgtttttgtcaattttcacggtgggccaatgactcgccaagggatctggaagaacctcaaagcatatattgcaagtatcggcattgaaaaagatgtcacaccgcacactcttcgtcacagctttgcgacaaggttgctcgaaaacggtgctgacctgcgcgtggttcaagaactactcggccacagcgacatcagcacgacccagatttacacccatttaagcaatcaacatctggttgcggtctatcataaaacgcatccgcgcgggtagctattttgacagggtgttcctttctaagaatatgtttgatgactaagagattgtggccatcagcattgccatgggcagtctagctcgaatactaagatagaaagcagagcgttggcggagcggcgatgggctcagtggtgcccaccactctagctgcgcggtcgccaccccgaatcgccgcggagccaaatcggacaataggattaaacttgattagcgtagaaccgagaaaaacttgacacatacgttcacgctctgccctttgctactgccgcgtttctatgatagagtgttacgagagtatctcttggaggcaaacatgctggttaaatacaaaaacgactatgagaagatcgcgatgggattgttgtcttttattccggatctgaaagatgtcgggcatttaaagacagaactcaagatgtacaccgaagatgattcccatgcgttgtatctatacaaacataagaatgattttgttggtgtcgttggcattgaactaagtgctgactttgttttggtgcggcatttaagcttttcacctaattttcgtgaccaagcaacggcatttgccgcgttgactgaactgactgaacttttcccaaacaagaaattgatgggtgcccttgaacatgcaccactaatcgccgcctttaacaagtttcgaaaagaggatgaccatggcactgacactcgtgctgaatgacttctccggaccgttagacttgctttggcacttgattcggacgaatgaagttgacatttacgacattccgatcgctgagatcaccgctcaatacctagattacctgcatcaaatgcaggatctggcgctggacgtggccggcgattattttgtcatggccgctaatttgatggtcttgaaaagtcgccttttgttgccgcaacctgaacccgaaacgatggctcctgatgatgcgccagatccacgagcagatttagtggcacaattattaacctatcaagtctaccaagaagcggcaaaggatttgaaagcacgcgaagctaaacgcgcacaagcctatgccaagccaaccacattgccagacgccaaaatggctgtgccacttgcgccaggttcggtgaaattagttgatttacaagcggccatggcgcgtgtgatgaaggcacaacaagccactcgccaaaccattgcccacattgaaaccgaacctgtatccgttgaaaaacgaatcggcgaagtgctacagacattgcaaaaaggcgggcaatgtctctttgctgatttactgtcggttcagtcggttgagcaagtcgtgacgacttttctggctttgcttgaattgatgaaaaatgatcaggttatttgtgaacaagaggcgccatttgatccaatcacagtgaccttgaaggaggctgcttaatggagccagcactagaagcaatcctttacacagctggcgaaagcggcgtgacgctgggtgagctggccggcattttagaaatcagcgaaagcgcgatgcgacagcaattagacgcgtatcgacaacggctggctgctgatgatcagcgtggcctgcaattgcagcagtttgcggaccggtattatttactgaccaaaccagcgtacgcacctgcaatcaagaaatattttgccgggccgccagctgcgggattatcgcaggctgcgttagaagtgctcgcgattatcgcgtaccagcaaccgattacccggattgaaattgacgaaattcgcggtgttcaaagctcaggcgcattaactaccttggctgcgcgacaactcatcaaagaggcaggccgaaaagaagcccctggtcgaccaattttatatgcgacaactcagtttttccttgactattttgggttgaaccgccttgctgatttaccaccgctagctgatgcgcctgccgatacaggtgaggttgatttgtttacggcatttcggcacgatgatgatcaagaggaagctactatagacgaaaagaaaatggagcaaaatcaacaacatgacaaccaaaactgaacggcttcaaaaaattatcgcaaatgccggtattgcttcgcgtcgacatgcggaaacgttgattgcaactggccatgtcaaagttaatggccaaattgaaactgaaatgggcatcaagattggtccgcatgatgaagtcgaagtggatggcgtgccgattggcaaagaggctaagcgctactttctcttttataaaccgcgcggcgtgattagtgctgttcaagataataagggacgtgatgtcgtcaccgattactttaaggatattactgagcgtctttatccagttggccgattagattacgatacaagcggcttacttgtgatgacaaacgatggcgatttagccaaccatttgatgcatccacgttacgcgcttgagaaaaaatatgtagccaaggttcaaggtgtaccgaatcgacctgccttggctccgctcaaaacaggtgtcgaggttgatggcaagatgactgcgcctgctaaagtagacattatctcgactgataaggctaaaaaaacggcgatcgtatctttgaccattcatcaaggcatgaatcatcaggttaaaaagatgtttaaagcagtcggcttcccagttctaaaactatctcgggaagcgtatggcaacttaactttggtggggttacagccaggtgaacatcggccaatcaagccgcaagaactgcaagccttgcgaaaactagcgggtgaatcggaaaataagtagttggtgaaattgttaacgttttcagtgcaaacgcttgaacttttccggcgcctttgctaaagtaaagctgttaattaaataatcttggttcgtcttcagggcagggtgcaattcccgaccggcggtatagtccgcgacccgcttatgcggtggaaccggtgtgactccggtaccgatagtgatagtctagatggaagaagatggggcttttttgaatctacattcaatcaagacctattccccctgaaggaggaataggtctttttaagttccggaagacggcctcacggaggtaatgctttatggcaagtagttccaaggttcaccgtttggttggtatcgcgttgttagcggcgatcgggtatgttttgatgatgttttcatttccgatcattcctgctttcccgttcctgaagcttgatctatcagatctggttgttttgcttggtgggttattatatggcccggctggcgggatcggcgttgcatttatccggagtcttgtgcattttgctttaacaggcggcggggtcgtcaatttaattggtgatctggcagctttcattgcgagcgttgggttcctgcttccagttgtttacacgattcgtggcaagcacagcttgttgcggcaaattgaaggtctggtactaggtaccgcaagcctgacacttgtcatgagtgtgctcaattggctggtgatcacgccgatgtacatggcggtcttcaattttaaccttggtatgtcgctgacgcgttacgttttaatcggcgttgtaccattcaacttaatcaaaggaattgtggtctcggttgcattcttcgcgatcgccaaggccttggcaccgtggttagctcggcgtgagattcaacctagtcattaatgatttaatcaatcaactaaaaaacatccgtcagcttagttaagcgacggatgtttttctttagcgtaaaatcgattgtcttgcgacgaatcacgtcaatcttcagatcacgtgctattggttcgcgtaatctgaaactatagcagttaagctttccccgtctcagaaaacgggcgcgcgttgaacgggtgatcgctacgtttgatagcgtgggtcgggcagcgttggtaggccaatcgaaagtcgatcgtggcctgatcgtttaaaggctcagtgccggtgttgcgatctggtttataataagcaatgccagcttgatcgtaatcaaaaagggcaggtgccaacatctgacacaagccgcaagcaatacactctggacgttctactctgccatataaagccatattcaaactcctttatacgatacataacacttaaacagcaatgttgagaaatgaggtgacaagctttgctgaccgattttgtgattcaatttttcagtgagcagccgcggcgtgagcgggctgtttttggactcttaactggtaagcagaccatttcaatcctttacgccgccttgattcaccaacaactgcaatggttgcatctttatccaagtctgtcaaaagaagctttttcagcggccatcacgacgttgaaagtgcaaagagtgctgcgtgaaactgaaaccggcttgattttaacggaaaaagggcagcatctcaagcaagcagcagttacgcagttaccgttaccgacacattatcaaccgtggatgaacttaccggtgttcgcaccgcggttctttttaggcgtgcaagtgctttctgaggcgagttatgcgaaccgtgcttatcaaccaataagtgttaattgggcgacacagcaagttgtgaagcagtggtatcagcaggtcgatcatcgagctgccgttacaacattaagcagcctttttcaaggactgccgactgaattagctgacacgctagcggctaacatgattggccatgactacgccggacaactgatgccagcaacattgcaggctcactttgaacgactcgatgcgctggcggcattggttcagcagctcgctaatactaggagtatgtggacggcgttgtggggcggaccccgcgatttcgtttcgcgaccggcgcagcagaccttggcgcaagcacgcgctggcatggcgttgccaacaattgctcatcgcagccaccgtaagcaaagcacgattaatgaacatctgttgctcgcggcaattatgggtgaaacgttgccgattgagcatttggtgccgcttaaaattcaccgtgcacttgatcgggtgacgcaaatctacgatcatcaggcattgttggcagccattcctggaagtactttttttcagattcgattgttccagattctaagttttcaagggaggtggccgcgtgtcacaacttgaagcacaacttcaacaacattttggctttcaagaattccgacctggacaaaaggctttgatccaatcggtgttggatggacatgacacgctgggaattttacctactggcagcgggaaatcactctgttatcaattgccgactttgatcagtaacaagccaagtttaattgttgaaccgctcattgccttgatgaatgatcaagttggtcgtttgcaagcagctggagaaaaacgggtcattgccttgtcagcgcaaatgccaccggttgcttttacccaaattctcaaacgattggcaagttaccactatatttttgtctcaccagaaattttacaacgcgctgatgtgctcatggcgctcaaacgactggccctaggcttatttgtggtagatgaagcgcattgtatctcacagtgggggccagattttcgacctgcttatttgcagctgggacaagttcgccaacaattgcaagcaaatgcgattcttgccttaaccgcaaccgcaccggagcccgttcgccgtgacattgtccaacatctaagcatgcaatcgccagcaattttggctgggtcagtcgatcgaccaaatattttccttggcgttgagaccggcttaacagataaggaaaaggctttaagactggatcagttattgcacgaggtggtggggccaacgatcatttatagtgctacccgagccgcgtgtgagacgttagcgatacgattgcaaaaagccggccatgctgcggccttttatcatgctgggttggatcggcaccaacgcgatctaatccagcgacagtttcaatcggatcagttgcagattatctgtgcgacgagtgcgtttggcatggggatcgataaggcaaatgtacggttcgtcgtgcatacctatgtgccggaatcgcttgaagcttattatcaggcaatcggacgagccggccgtgatggcaagcagagtctagcggcgcttttggtgaccgatcatgatgttcagcacggcgctattttggcggggatgttgccagatgcggcattgattcggctcatctatgcgcatcctgaggcgtatcgcacttttgacgatccgcagatcaatctgattgaagcgtatgtagacgctggcttttcggtagaggctacgcagcagcaattacagcacagactaactgagaaacaggccagtttcgcagcgatggcggcttttgttaatgaatcagaatgccgtcgtgctgttctgctgcaacattttgattcgccaattgaaccgcatacggctttgtgctgtggtgagatcaccactacgatattgtgccaactacagcctgaagtgccacaagaacaaccaaaattagcttcttggcaggcagtatttcaccaaatctttagataaccgacgctctgacgctggtcaatatgatacaataagcgcagtagtgagggggatcgtgatggcggaaaaagatgaacaccaacatgacaatgaggatcacaagcgcaccaatggtgaggatccaagtaaaccttgggaaacgctgtttgacgatgatcgtgatgatcaaggtaatttgagccgcgttgccaccaagaaaaaaaggcaaggaagttcaaaattgacctggattttagcgatcttgttaattcttgtggttttggcaccaattatttatgtcaaaatttctggtgatcaaagccgcaatggcgctaacctttctaatgatcgcgttgtgatccaaagtactaaaaagagcagtaaagtttcaaaatcaaagaaatcatcgaaggcttccaaagcctcgaagacttcagtggcctcgtcacaggcagcgtcgactcagcctagtcaagcaccaagcgttacttcccaacaagaagaacagaccagtgcatcagcgcagcctagcgagcaagcaagtgccagcacggctggcagttcatataccgttcaagcaggcgataacctttatcgaatcgctgtcaatcatggaatgaccttagatgagttgctccagatgaacggtatgagtgcgggttccagcattgcaccgggcacggttttgaaagtgaaataatcatgacacgaccctgttctgcatgcgtattggcatgagcagggtcgtgtgttgtggaggaaagtatgcaaattgcgatcgacggcccggccagtgccgggaaaagtaccattgcgaaacgagtcgccaaggaattagggtttatctattgtgacactggcgcgatgtatcgcaccgtgacctacatggccatcaaagaccagctgggctttggcgatgaggcggctatcatgcagcatctcgccaacatgacgattcggtttgaaccgggtgaccctgaacagcgcgtcttaatgaatgatgaagatgtgaccttagccattcgcgaaccagacgtgaccaacaatgtttcgcaagtgtcagcgttacccaaggtacgtactgaactagtgaaacgccagcgggatatcgcagcatccagcaatattgtcatggatggtcgcgacattggcaccaccgttttacctaacgccgaagtgaagatttatatggtggcatcagttgctgaacgggcaaaaagacgctacaaagaaaatattcaaaaaggcattgagacaccactagctaccctcgaacaggagattgccgaacgcgatcgcaaggactctcatcgggccgtttccccgctacgtcaggcttctgacgcgattagaattgatacgacatcaatgaccatcgatgaagtggtggaacgaattttatccctgataggccaagtaaagacgaaatagtcaagggcttaaaataataggtggtaatttggttcgttttcaagtacaatagatccagtatacagctgcataggaggattttttggcatgagtgataataacgttaatgagaacaccgaaacaatggcggacgcccttaagagtgtcaccacagtaaagattggtgataccgtcaaggcagacgttcttgccgttgaagataaacaattgatcgttgggatcgaaggaacaggcgtcgaaggcgtggtcccgatcaaggagttatcaactcagccaatcgatgacattcacgatgttgcaaaagtcggcgacaagcttgatttagttgtgctttcaacggttggcaaagataaagaaaatgggcagttcctgctgtccaagcgccgtttggaagcgcaaaaggtttggaaagaaatccaagctaagtatgaagcaggtgaaaccatcaccgctccggttaccagcgtcgttaaaggcggactggttgttaatgccggtgttcgtggcttcgttcctgcatccatggttgaagatcattttgttgaagatcttagccaatacaagggtaaggaacttgaattcaagatcattgaaatcgaaccaagtgaaaatcgtctgattctttcacatcgtgcgattgttgaagccagcaaggctgaagcacgcaaggaaatctttgcgaagattcaacctggcgacaccgttgaaggtaaagttgctcgtttgaccaactttggcgcctttgttgatcttggcggcgttgatggtttggttcacgtttcagagatttcgtttgatcatgttgacaagccaagcgatgttctgaaggttggtcaagaaatcaaggttaaggttctgaacgttgatcctgatcgcaaccgcatttccttgtccatcaaagcaacgttgccacaaccttgggacgacattgaagaaaaggcaccggccggctctgttttgactggtacagttaaacgtttgaccacttttggtgcctttgttgaagtcttccctggtgttgaaggtttggttcatatttcccagatctctcacgaacacgtagcaaccccagcggatgtccttaaggaaggccaagaagtgcaggtcaaggttctttccgttgaccctgatgcacatcgtcttgctttgtccatcaaggctttgcaggaacgtccagcaggctctgaagaagaatctcatgaaggcggcaacagcagtcgtgaaaatagcgaccgtggtgatcgtcgtcgttcttcacgtcctcgtcgtggcaatgatcgtcatcaatccacgtcgattcctgctgaatatcagcaagatgattcaggcttctcacttggcgacatcttaggcgatgccttgaaagatgctgctaagggcaatgatgatcaggatgataacaagtagtcatcttgaacctaaaaagttgagccttggctcaactttttttatgggaaacaaatcccatgacgccgtcacagaaaggaggccgttttatggtcttaccaacattagcaatcgttggccgtccgaatgtgggcaagtcaaccatttttaaccgtattctcggtgagcgggtttcgattgtggaagatacgcccggggtcacgcgtgatcgcatctatggcacgagtgaatggcttggtaaagaatttgccgtcattgacaccggtgggatcgacttaggcgatgaaccttttttggcgcaaattaaggatcaagctgaaattgccatcgatgaagccgatgtcatcctttttctcgctgatattgaaagcggggtaactgatgcagatgaacgggttgcccagattctttatcgggctaaaaagccggttgtactggcagtcaataaggttgataaccctgaacgtcgccaagatatttacgatttttattcattaggttttggcgaaccctatccactttctgggactcatgggattggccttggtgatgttttggatgctgttttagcagcatttccatccgaagataagtcagttgaagacgattcgattaagttcagcctgattggtcggccaaatgtcggtaaatcgtctttagttaacgccattcttggtgaaaatcgggtcatcgtgagtccaatcgaaggcacgacccgcgatgcgattgatacgaagttcgaagcagttgacgaaaccttcacgatgattgacacggctgggattcgtaaacgtggcaaggtttacgagaacaccgaaaaatacgcggtcatgcgtgcattacgagcgattgatcgttcggatgttgttttgtttgtcatcaacgccgaagaaggtatccgcgaacaggataaaaaggtcgccggttatgcccacgaggccggtcgtggcatcatcatcgtcgtcaacaagtgggatacagttgagaaagataatcacacgatgaaggattttgaaaacctgattcgtcaggaattccaatatctggattatgcgccgattatttttgtttctgccaagacgaaacagcgtttacagagcttgccagccatgattgtggcagtttcagaaaatcaaactcggcgaattcaaagcagtgtcctaaatgatgtcttaatggatgccattactgttacaccgacaccgacagttaacggaaaacgcttgcggatttattacatgacgcaagttgctgtcaaaccgccaactttcgtggtttttgttaatgatcccgacctgctgcacttctcgtacgagcgatttctgattaaccaattgcgacaggcctttgatttttccggtacaccgattcacatcatcgcacgtaaacgcaagtagttcggcgatggctgaatattgtcttttcatttaaaaaaatatgtcaaaaatcgtgattttcgataaccgatccttgatcagacagcaaaaagtttggcaaaaaccttgtcacaacgggcttgctatgctatgtttaaacctgaaatggtgatacatattatcattgtttcttcattcctgagaggtcaggaatgggcatgtttaggtgttaacgcatctaatcaatatggaggtgaaatgttcatggcaaacaaagcagaattgatcgaaagtgttgcaaccgcaactggtttgaccaagaaggatgcaaccgcagctgttgatgcagtattcggttctatccaagactccctttcaaagggtgacaaggttcagttgatcggctttggtaacttcgaagtgcgtgagcgtgccgctcgtaagggccgcaacccacaaaccggtgccgagatcaagatcccagcatccaaggtaccagcattcaagcctggtaaagcactcaaggacgccgttaaataagcggttcacctgaggcaatgatgaaacaaccaaaaaccgagtctatctggactcggtttttgcgcgttttggcgtcattcgccagcgaccaggggcgggaccgagcgacagtagcgatatgcgcagtcaagtgtggctggagagcttttgatgctcatcagttcggaatcggcaaaacgcaatgttaaactagcagtaacgacaatctttaggctttttataaaataaaatcaacggaggcagccatgagttacgcaaaagaaatgcttgatgccattgaagctggccagatggaaacggcgaagcagctattcacccaagtattggcccacgatgacgacgaaacccaatacaaccttgccgaagaactgtatgcgcttgggttcaacggtcaggctaagcggctttatcaagggctcctggggcgatatcctgaccaaggcgatctggcaacggctttagctgatattgcagtttctgacggagatacagacgccgccttgaattatcttagtcgcattcagccaggtgatcctgcctatgttcaaagtctggtgagcgctgccgatgtttatcaaacacttggtttatatgaggtcagtgagcaaaaactgcttgaggcgaagcgattggcgccagacgagccggtggtgaccttcgctttaggcgaattctattttgactggggtcattttgccgaggccattagtgcttataacgagctgctagcggccggtacaactgaacttgctggggttaacatcgaagcacggttggcggccagtttagcgcaaacagggcagtatgaagacgcagtggctgcttatgaagatgtcggtgttgatgcactggatctcaatggccggttcgaattaggcggcttgtatttacaacttgatgatccagctaaagcgatcaccaatcttcaagccgtgattgacagtgatccaagttacgccaatgcgtatttgccacttgctcgtgcttatgaggcccagaatcagcctgacaaggccttagacacggttcaggccggcgtcatggtcgatgatacgaacccaacgctatatgccttaggcggcaaattagcgcttagtgaagacaatgtcaaattagccgagacgtatttacaaaaggctttggcgattgatccggaagatcaaggtaatatgctcgcttggagcaactttttggtgcaggaagagcgtgatcaagaaaatgttgactttcttgaccaaatcgatcgtagtggtgatgttgacccacaaatttattggaatatggctaaaagctacgatcggttggagaatattaaaaaagcccgtgagaattaccttttagcgttcaatcgctttcaggattccccggactttctccacgatatcattgatttcttccagtcgactggtgctcgcgccgaattgaaagccgctttagtgcgatatttgaaactggtacctactgacgacgagatgcaggcccgtttggatgaactcaacgccgagacggattaatcgttgtgaatcaatgaccaaatagtagtcggcggcgttttttctggtaggtgaagccttcgcccaaggcctcatggacatcaaggatgctgatgaaggcgtgcggatcaatggcctcaatcagccgttttgtttgggcaatttcagttgacgaaacgacagcatagacgacctgcttgcgatcgtgggcgaacccgccttcagcatgtaagaaagttgtcccacgttccaattcgttcataatggcagtggcgatttcttggcttttgtcagagacgattaaaaggccctttgccgcgtaagcaccatccagcgtaaagttaacaatttgtgagaacacgtaggcaccaagcagagtgtacatcatgagttcgatgttcagatacgtcaacgagatcgttagcacagcggcatcgaaaactaacagggttcgtcccattggcacgccggtctgttgttcaactatccgggcaacaacatccgtgccgccggtggtcccgccatggcggtaaatcaagccgctgccaaaaccaccaaacagtccagctaaaaccccggagataaaaagatcatgatcgaggttgatggttaaaggtacccgttgccagatccacagccaagcagaaagcatcaaggtgccaaaaacagtgtaagctagggcacgtttgcctaaaaatttgtaaccaacgatgagcaacggaatattcagcagaatcgtgctgtatgccggatcgagatgccaccaatagcggattagcaaggtaatcccggtgacgccgccttcagccaagtgattcgcaatattaatataaacaagcccgaacccatataaagcacaaccaagaacaatcattaaaagatcccaacaagtacgcgtggtgcgtgacataggccgcctcccaaaaaagaatttaagcttattctaacagaaatgtcatatttcggcttaattgtggtaatggtggctgccggtttggaaaaaggagtttgaaatgcgactagatttgacccagccagattttaaggcagcgattccgattttaaaaaaaatcgaagctgctggttatgaagcttattttgttggcggcagtgttcgtgatgcgatactagggctgccgattcacgatgtggatattgccagttcggcgtatccggcagaaattaagcgaattttcaagcggacagcggataccggcatcgagcatggcacagtgatggtgcttgatcacgggactggctatgaagtgacaactttccgaaccgaatcgcgctatcaggattttcgccggcctgatcatgtgacttttgtgcgctccttagcagaagatttaaagcgtcgggatttcactatcaacgctttagctgttcggcatgatggcacgatcattgatttgtttgacggcctaaaagatttacagcaccaccagctgcgggcagtgggtaatcctcatgaacggtttcatgaggatgctttgcggatgatgcgggcagtccgattcgagagccaattggggttcggtattgagccagccaccaaagcggcaatcgccgacaatgccaaactgttagtgcacatttctgtagaacgagtcgccgcagaatttaatcggttgctgactgggattgatcgacgcgctggcttgcaagattttattgagactcgcttgtttgcctacgccccgaaaatggcggctcatgaaacagccttaacgcaattttctcagttgcctgatacgcaactgaccagtttggcaagcggctgggcggcattgattttccttttaagaacacagccgctggtgatgctaaaggcctggaagcaatccaatgagctgatcaccttggtcacgcaaactgtcaagctactgcaggtgatgccgaatccgactgcttgggatctttaccaagctggcgaagcggccgtgacaacggctagcgaggttcaaaaactgctgacgcctgactttgatcagcagcagctagctgaggcttacgcggccttaccgattcatagtaaaaaagaattagcgctgaccggtgcagatctgattaaagcgggggtccgtcccgggccagcgatgggcaaagcactcaatcaaatcgagcagcgtgtcgtcgctggagctttgccaaatgaactaaaaaagttgttgccgatcgcaactgaaatgtctcaagatcgtttgtgagtgtgttatgatgagcatgtaagcacattcaacaacgtcaaacaggacgattgatcagctgggcggctttaaaatagcatagttggccaccagtgcgtttccaacccgttctgcatgacagtgaagggggatttccaatggcagaacatgtttttgagcaattgatttttcattttcgtaacggtgacgaatggactgttgagcatgatgaactggcggacgtctggatcagtcgagtaaccacgagttacggacgcattcacggcggtcagattcaagagattcatccttgcaagagctttaaggttgaaattttgcctgaagctgaccacgtcaagtcaagcgatatcaacaccggttcgctggagatggggatgtttggtcgcgctactaagtatcaagatattgaaaagatggacttggtctttaacgcggaagacaaaaagcgcgttcaaatctacttcccattcaagcaaaaggatccaagcgggcttgataacgagtaccagagtagcaagcttgcagcaaacggtcatctttatattgtgatcgatgaaaaacataccgtggatgatgaatatccgcggatctaatcgtgatcacgtacgggtcggcattgatgtcggccttttcttgtgcgctgcttcttgctaagatggacaacgatacgagtgaaatgagggacaacatgcagacgctaacagcgcaaggcctgagtaaggcatatggtgacaaacaattattcaatcagattgattttttaattaacgaaggcgagcgaattggcttaattggggtgaatggcgctgggaaaaccacgcttattcgcgcattagccggacttgattcagttgatgctggtgaaattaaaacacccaagcaatatcgcatcagctatctggctcagattcccgatcttgatcctgacttggcgattatggatgccatttatcatggtgactcaccggtttttcaagcgattcgccaatatgaacaagcactagccgaatataccaaggatcctatgaatccggaaaaaactgccgcttatacaaaagcagatgcccgcatgacgcaagaagatgcctggtctgcagaaaccgatatcaaaacaattttgacgcagctgcacattgatgatttgagcatgcgtgttggcgatctttccggtggtcagcaaaagcgtgtcggtctggcccaagtgctgatcgaatcgccggacttattgctgttggacgagccgacgaaccacttggattttgattcaatcacgtggcttgagaagtatctcagcaattatcgcggcgctttggtcgtggtaacgcatgatcgttattttcttgatcgtgtgacgaaccggatttttgaattggatcgcggccgtttattccagtatcaaggcaactatcaggcttatgtcgccaaaaaggctgagcaattggaggctgaaaagtcggctaatcacaagcaggcccagctttacaagcaggaactagcttggatgcatgctggtgcccaggcacgttcaacgaaacaacaagcgcggattaatcgtttcgagaccttgcaagctgccaaagatgcggcaccggaagcaaaccagcagttggatcccattcagattgccagcgcccgcttaggcaaaaaagtcatcgaaatgcatcatgccagtttgcagtttgacgatcagccgattctaaaagactttaattggctggttcaaccaggcactcgcattgggattaccggcaaaaacggcgctggcaagtcaacattgctgaatattattgctggcaaacaaaaattggacagcggttctattgaattaggcgagaccgttcatttgggctactacacccagatgagtgccaatttggatccgaacaaacgcatcatcacctatttgcaggaggttggcgaagaagtcgtgcaagcagatggtcaacgcgtgtcagtgacccaaatgctggaacaatttctttttccgcgcagtatgcatggtacgctgattggtcgcttgtcaggcggcgaaaaacgccggctttatttgctacaggtgctcatgcgtcaacctaatgttttgcttttggacgagccaaccaatgatctagatattgccaccttgaccgtactcgaagattatctggatcaatttccaggcaccgtcatcaccgtgtcacatgaccgttactttttggacaaagtggctgatcaattgctgatcttcaatggcaacgcgcagattgaccgagcggtaggcgagttctctgattatctggctcagcaacaaaccaagcagccggcagccaaaccaaaaacatcagccgctgacgctgtaccgaaaaaagccgcgccaaagaagaaaacaaaactgacatatgctgagcagatagagtatgataaactccaaaatgagcttgacgagttggacgataaactcgccaaagtcaaggcagctatggccgaagtcaacggtgaagattatgtcaaactaggtgatttacaagcccaaattgacaagatcaaccaaacagttgataaaaaattcgaccgatttgccgaactggatcagtatgtttgaacacacgcccactggagggaagaagacaatgttagagcagccatatctcgatcttgcccaaaaagtattagatgaaggccatttcaagcctgatcgcacgcatacaggcacgtacagtatttttggtcaccaaatgcggtttgaccttagcaaagggtttcctttactaacaaccaaaaaggtgccctttggtctcattaaaagcgagttactttggttcttgcgtggcgacaccaacattcgtttcctattgcagcacaaaaatcacatctgggatgaatgggcctttgagaagtgggttaccagccccgattatcatggtccggatatgaccgattttggtcatcgcagccaaaaagatcctgaatttgccgccagttatcgtgaacagatggccaagtttgacgaacgtattctcactgacgagtcatttgcagctaaatacggtgatttaggattggtttatggctcgcaatggcgggcgtggcataccagtcgcggtgacaccattgaccagctaggggatgtgattgagcagattaagacgcatccatactcgcgacgcttgatcgtatccgcttggaatccagaagatgtaccaaccatggcgttaccgccttgtcacaccctcttccagttttatgtcaatgatggcaaactttccttgcaactgtatcagcgttctgcggacattttccttggcgtgccgtttaatattgcctcatatgccttgctgacccatcttgttgcccatgaatgcgggttgcaagttggggacttcattcatacatttggcgatgctcatttgtatgtcaatcatttggaccaaatcaaagaacaattaacgcggacgccacggcaggcgccaaccttggtcttgaatccggataaacacgatatttttgattttgatatgcaagatattaaattgttgaattatgatccttatccggccattaaagcaccagttgccgtttaagcgaagcacgtgcttgggctgccttgtcggcgagaaagcttattattggcgatatcgaagctgtttaagtgacggttctgactgattgcagtaccatcagacgtatcaaaaacgagggggattttaaatggtagcatttttgtgggcgcaggatcgggatggtgtaatcggtaaagacggccatttgccatggcatttgccagatgatttgcattatttccggactcagactgaaggaaaaatgatggtggttgggcgtcgcacgtacgaaagttttccaaaacggccattaccagatcgtacgaacgtggttttgacgcaccaggctgattaccaggcaccaggcgcgattgtcttgcatcaggttgctgaagtgcttgattatgcgaaggaacatgcagatcaggcattagtcatcgccggtggtgctcaaatctttagcgcctttaaagacatggttgataccttgctcgtgacccgtctagccggcagttttgcaggtgacactaaaatgattccactagattgggatgcgtttactaaaacctcaagccgaactgtcgaagatcaaaaccccgctttgacgcatacttatgaagtttggcaaaagcaaagatgatctgacgcgtttagcagctaaagaatttttttaaggaacttaaatagttatgtgcatttgtagttcgattttttaactaaaattgactcatgtgcaaaaaagatcggcttctccgtctgacggagcgagccgatcttttttatatagttagcattaaacgaaaaggtaaattgaaatgtacatgcacaggctaccgagaatgacaaacaggtgccagatgacatggatgtaggggatgcctttttgcaggtacagcatagcgccacctgtgtatgctaacccgccagcaaccagtaaccagaagccaatcggtcctaagtgatgccacagtggcaccatgccgattaagcaaagccagccgagaatgacgtaaatcatggtttccagatgcttgaagcgattcaagaagaacagcttgtagaggatgccgccaaagcaaagcgcccagatggcaattagcaagccgatccctaatggtccgccaatcgcgatcaaacagtaaggcaggtaggagccagcgattaatatgaaaacgccggagtgatctaggacctgtaggacatggcgcgccttgctaaaatagaaaccgtggaacgccgttgaagccgtatataagatgatgagggaaatcccaaatcctaagtagctgattaactcaagctgactgccactattggcacccttaatacccaacgcaatcgtgccaaccactgccagccctaaggcaaatgcatgggttatcgcactaaacatttcattattaaattcataatgctttgattttgccacgcgcatcttctacctccttggtgcaaccggtacagatttctttacgagaattgccgggcacgcttcaattcacttacgattttagcatggtacgtttcacaatacaacctaatctagttatgataactagataatatgtactgacaatatttctggactttgctataatgagttcgataaacgaacctaacagaaagcgtggctcagacatggcaaatatcaagatcgtcacggattcttccgttcaactgactccagaagagatcagccaacataacattacggttgtaccgctaaccattatgattgataataccgtttatattgatggcgaaaccatcacgcgggatgattttatggatgaaatggctgcggcgcaaaacctgcccaaaacctcgcaaccagctgtcggcacgttcgccgatgttttcgacaaactgacagcagacggcagcgaagttttggcaattcatatgactgaaacgatcagcgggacggtgaattcttcgcggcaagcggctcaaattgcgaaaggcaaagtgacggtgattgactcgcagttcacggaccgagcgatggcttttcaggtcttagtcgctgctgaaatggccgaagccggcaaagatatgaaaacgattcttgataagcttgagcaagtgcgggacaacacgacactggtccttggcgtaacgaatttagacaatttggtcaaaggtggccggcttagtcgtgtttcaggcttaatttcatcgtttttgaacatcaaggtcattctgcaactgcaaaatggcgaattgaaagccttacgcaaaggtcgggggatgaagacgattaataatttcatcgccgaaacaattgctaaaatggcgaaactcagcaacatcaaaagtgttggtatttcaacggccggcgctaaggaattaggtgaagacattggtcggcgcatcgcagaagtgctaccgagtgtcccgattctggtgcgaccgactgatccagtcattgcaacccatacagggccaggtgcgtttgcaattacgtactacgttgattaatttttaataaaatttaactggccggcggaagcgccggcttttttaaagcacgaacacttgtggcttgagaacgccgtatgcacggtttcaggcatgatcaaggcaacgacagctggtgatgcctaaaacggttaggcgggcatctgcggctacttgtgccctgattttagagagaagcaaagccggcaccatttttgaatcaaactgggcgcccttgtcgactgtttttggtcattgttaatgatcattcagaaggagcgcctttgttaatttgtacaacgtcaagtacaatagcctattaataccagtcatttgaccagaaacacaggaggcaccatggccaagttaaaaagttttcttatttcattcggtgtcattttgctagccggtatagcggcttttttaagctggcaagtattcggccctgccgctgcgcccagtcaagtcaaactgacggctgatcagccgaagcaactcaagctgacggcggttggcgattcgctgacatacggcgttggcgatgccacgaataacggtggttttgttggactcactcaggccgatttggaagctaccggccaatatcaagtcacgacgaaaaactatggtgtcagtggtaacaccagcacccagattcttagtcgcatcaataaacaggcgaagattcgtacagatttgaagcaagccaatatcattaccgtgacggcaggcggtaatgatctgatgcatgtgttgcagcaacattttcttagcttgtctgaaaaagagatcactgctggtagcacggcttttcagaaacatctaacgaccttactcacaactattcgtaaggagaacgcaacggcaccgatttatgtttttggcatctataatccgttttatgtttattttccaaaaatgacagcgatgactaatagcgtgagtgcgtggaatcaggcaacgcaaaagaccttgcaaggcttccaacgtgtctattacattgacatcgataaggtcttatcaaatggggaaactgtcgccaacaaggcttctgcaaaagaggctttgaaggaagcaacatctggagatggcaacccgctgatcttttcgcaagatcattttcatcctaataatgccggttatgcgcaaatgactaaacaattgatgacgaaactaacagccacaaagaaagattgggagtgattagggtgacagaaaagaaacggcagcgcaaacaaaaatcgatcagctggtcaatgattaactggtggaaatgggcatttttaatcctgattggccttatcttgggtagcggaatttggtttaccaaaaccgtcttagcgccggtttcactgaacacagccacagagactaagacgatttcaaacgacccggttttcacggttaaagtcaccaagagtagtgccaaccgaatcatggcacattatttaaaaacctatctgaaggacagcccaattaaatacgccgtcacccttggcaataatgaggcggcgttgaatggttcgttcaaatttcttggcaataatgtcaagttccaattgacctttgatccgttggtacttaaaaatggcgatgttttgctaaagtcaaagaaattgaacgtcggtacattgccagtcccgattagtttcgtaatgagctatattgggcatagttataaaatccctagctgggtcagtcttgatagtaaggcaggaaacgttgtgctaaaattgagccaatttaaactccaaaatggcatgacgcttcgggcaactaaactagatccgacgaacgatgacttagagttcgcagtttacctcccggataatcagtgatcattggaaagaagctgaatattttatgaaaaaagaaacagctatttttgctgggggatgtttttggtgtatggttgaaccctttgaagagcagccgggcattttgaatgtagtgtccggctacactggcggccatgtcgccaaccccacctatgaacaggtttcgtctcacaccactggacatactgaagccgtagaaatcaccttcgatgccgacactattagctatccgcagttgttggacatctattggcagcaaaccgatccgacagatgctatgggtcagtttcaggatcgcggcgataattatcgaccggtgattttcgtgaaggatgatgcccaacgcgaagctgcagaggcttcaaaaacggccttagctgctagtgggcgcttcagtgatccgattgtgacgcaaatcgaagctgccaagccgttttatccggctgagcctgagcaccaacagttttatgctaagaatccccgccgttatgcattagaacatgcacaacggcaggcttttatcgacacaacatggaaggatcaataatgcatcggactttttacgaatatctcatgaccctgcgtaaccccaatgaccatagtgaaattgctgaatttgcgaaaaatgcctttttggatcaaagctttcctaagcaagaaaaggattaccatcgactaagcgattatctggaactaaacggcaattatttgccaagcatggccgtttttgacgaaacgtatcgcgcctatgaggcgagtgaaagcacaggaggcgattcgtatcaataaacgtagattaccgtggtgggccgttttgataattgtcatcgtcgcacttggcggtggtgtcgcaggcggttacgcgctctcttatcagcaagcgcaacaaagtgttttgaaaacaagtgtccccaaggaactagcacccgttattgctgcttatgagacggttaccaataactactataaaagcgtcaatacgaccaaattaaccgatggcgcgattaaaggtatgctggcaacgttagatgatccatattccgtttacttgcagaataacgataaaaccaatcttgatgacacgatttcggcttcatttggcggtatcggtgccaccatccagcaaaatcatgacagtctttccatcgccagcattttacctgacacgcccgccaaaaaagcaggcatgcaagtcggcgatgtgctgctcaaggtcaacggtaaagatgtctccaaacaaaccgttagcaaggcagttgccaaaattcgcggtaaaatcggtaccacagtgtccgtcaccgttaagcgcggcagcaaacaagcgaccttctcgatgaagcggcagaaaatcacggttgacactgtcactggccaacttgcttcggccaacaaacaggtcggcgtcattactatctcgacttttagcgaaccaaccgtcaaacaattcaaggccactgttaagaaattacgcaaagaaggggccaaatcctttgtcctcgacttacggcaaaatccaggcggcatgatgagtgcggctttgtccatcagctccatgttctctaaaaacggccaaactgttctgcaagtcgaagaccgcaacggtgccaaggaagtctataaggctggcaagaaactcgatgacggctttaaagtcactgaaaaaacggcggtcttaattgatggtaattcggcctcagccagtgaaatcaccgctgcagcacttcaccaaaacagcaacattccgcttgtcggtgaaaagagtttcggcaaaggcaccgtccaaaatgtcggcgaaatgggcagcaacaaagaactcaagctgaccatcgctaaatggttaacgccaaacggcacttggatcaatcacaaaggcctgacacctgatatcaaggtcgactacccagccgcggcgaagatcaccttgatcaacgccactcagctcaaaccaggcgataaaggcagcgatgtgaagtccttgcaacaaatgctcacggcacttaaagtcggctccgtcactgtcaatagtcaatacgacgatgccacccaagccgctgtcaaaacgttccagcaagcaaataagcttgacgcaacaggaacagcggatcaggatacgttggcaacgctcgcgcagaagttgagtgcacagttgaccaaggatgatccgatgatgaaggcggctgtggatgcggtagccaagtgaaaatcaaataggttatgatatgcgcgtatatgccttttaggaggtgtgtacgcgttttttgatacctattgctagaaaccaaacggagggaaagagatgtcagttgaattagaaggatttgcggtgtatccgaataaagttgtaaggaccaatgcgtggatgacttttttgagaacacatcagagggaggttgacgtcacgcttaggccagagcacatcttagtggagcggattttctcgtcatctgttggtggacgtttttatttgtgctggtatccggagcaaaccgctgcgagtccggatgtgactgaaagcttaaatccgattgatcaggcgcatgtgacgttttggcgggagtgcgttgatgaaaaggtgcctcggttgaggtttcggttggagaatagttttcatgcttgatgatgagataatatcgatttaaagatcggctaaacaatatataagacattttctattagttataataatattgtttatcgaataatcttattaaatgtataagattattgtaagaaagaagacctaaaaagtgtacaattaagttttgtactattatatttaagttgcttaagcgcttaaacaataccaacctggacacaagtataagttactttagttttaaagtgtttcaacaaaaatcgtgtatatatcgcggagagagcatgctgttctgacctgacagtttttttgagtccttcacagtgaggatcaaaaagattagtcatgaaggcgctttttacgctgcaaatgctgttatgaaaaaataaagaagagatggagtttgaaacatgcaaatttccgatttttggaggatgatcactgatctagaatcacgatcgcctgagcatgcactcatgcttttaaatgcgcctactggtactggaaagagttacacgattgcacaagcattgtgtcaatatgcagctgaccatgagaattttcgggctttctttgtcactgaccaaaaaaagaatttcaatgagcatacttttaaagcagcctggaacaaacacgcgagatcaagctgtggtacttttaatcaacgagtggctattttacgttctttggaagataccgtcaataaaatcattggggactgggataaccaacaaatgccggccaaatatcgatcatcagaatctgttaggaaggtatttaagaacctaaagatgcatcttggtttatttcaagcctataaacatcaagccgctgattcccagacctcgtgggaggcgctgagaaaagccgagttcgaattccgacaagcaatcacggtccaactggcagattcggtcgaattgactgtgccccttgacgacgaaggtcagaagaaagcttgtgactatgttgcgaaacaagtgaattcggaaactaaatggttgaatgaaacatatccaacgattgacctttatcgtcgacaaatcatcattttaacaacggcaaaatttaccagaagttatacgcctttcttccaggaacacgctaagtcttttcagtttgccccaatcattcacaatgcgctcatcgtcatggacgaatttgatagcaccaaacaacaagtcttggataaagcgatcgatgatgctttaaaaatccaggcagacctgattatgctattcgaagctttgcaccaaggattcaaaaaaatggatgaagatgttttaccaagccagttgagagattgcttcacagcaagaaaacagtttaatgttttaaaagaggagggtaaacagctgcgctccaagtttgccttgaggcatttgtataagacagaggcagtttcgcttgattccggctttgtgatccatacgccccaaagacaattgatcagcgcaggtaagccctggcacgcatacttagatcatcatttgaaacaggttgtcttggggcaacaggcgcgagacgacttgcactttcagagaatgttgcccagggtttacacatttttgcggcgaacaacgcgcttttttagtgatcgagctcgcgattatcaaggcttaaaaaattctgaacagtcaaattttgatgatgctatgacaattgatgatgcttgccatagtatctataacgcactcggactgtcaggtgaacagattaaggttttactctcgctgggccatgattactcgtctgctcaaggcattaaatctaattatcatgcgcatagcacccatcgctttcaacaacaaggtctaagcctttttcaaatgatgaacgattatcagcatgaattccggactgacattgacgcttctttttttaaagtaactccggaaaggtacctgttgaatttactaaataaagccaacattcttggcttatcagcaactgctactttgccaacagtgctagataattacgacctgacttatctgagagagatgttaggtcctcgcatgataaacgggatcgaatttttgagtgcagaaactcaagaagaactggattttgaagggcgatatgcaaaaggaaacattcaagttaacgcagagatggcatattgggacttcattcgcctcaatctttgaaaatcgtttgaaacaaaatgggttggtgattgaatccactataattcgacaactagatgcagcattagaaaagaaggccaatgctgtcaagaacaacgagcaagagggaggaagcggcaaagactactttaaacaacgctacattgctttgttcgacagtttcgttgttttcttgaccgatcccatgctgacatcttttttaggcttgcagtcgcttttgccggggaaagaacaaggtggcatggatcaagaatacctttcagtgacttttgatcggcttaaagaacttttaactcaacaatttacagaagctgccgataccaaattgaaaattatttcgccacgaaatggcgagaacgttcagtccgatctcgcagaagctttagccatcccaagtcatgaagataagcgtgtctatattctcagtgcgtatcaaacggttggagtaggtcaaaatcttcaacatgtcatgaatgaattcgaacgggaacatgccgtgaatatcgccccaaaaggagccaattcatatgacctacgacatgaaagtgttgatttggcgggcatctatcttggcgatgtgacgcatattcttaccaacactcgtcagtttaggatggatgcgtccggactccgcgccattatcgaacgagaatatctttttgacacttacgagatcaatgtgacgaccttaaacacattttttactaacttggagcgaggaagatggcaggcctatcctaaaaatgcacgtagtctttatgtcagttattcgcggacgatcattcaggcgctgggacgaatgaaccgggctttcaacaagatgccatgcgtccgtatcttggcaagtgccaatgtactgggcagtatcacagggaacgggatcgatctggaagagacaagcttcgaatatcggcgtttgctggactatgcagatgaaaaagcgccgacattcgaaaagacgagatcggaagccttcaaacagaatgccactttgtatacccatcgtgatcttttatttttaaaatcccatttacaaactaatgaacaagatgcggagtactatcgtgatcttcgtctatttgtggcaaaacatccaactgcttctgaggaagaacgaatagggaatgcggtcttcaaacggcgtaacgatgagtctggatttcaatatttacctgcagaaaaacacgaaacaaaatatgaagtcaaacccgatacacgcgatagcggctgttttgactttagtaaaatcggaatggaaatttccgccgaggcatcgggattgaccataatgtgccgttatcccggcttaaagacacattttgaagatttggagattccgacagaatggttgccgaatgaacttattttgaacccggtgcaatacaggaatctgtatcgcggtcaaataggtgaagtggcgggtcaatttatctttgaaaaagagtggcgacaaaaacttcaggattttgacgatttagccaataacgaattatttgattttcagtgtcaaggcgaggtggctattgattttaaaaattggcagggtcaaccgaacaaagatactgagaaggaacggcagcatgttgcacagaaactcaggcacttgcaagttaacactggtcgagaatggcgagtcatcatcgccaatgtagttgcgattaacaaaggtaaaccgaccattacgattgacgggaaaatccttgaaatctctggactcattgatgagcaaggaaagcttgtgttgaccccagaacaaaaaatacaaatagggaggtttttgcatgcaagaccaaatgacaattcagacgactaggctcgactataaactcaatttaatggcactacagtcagattatcgatttttacaagtgactgtaaaagaaggcgccttttcgaattacaacaagttgatagcttcttggttgcctgaggcggtcatgacgcctcgtcgcaatatgtacgttctgatgtttcgtcaactacctttattacaacaggttgaggggcttgagatgcgcgagattatgttggcagaaatggaaacagattctatttatccgaatcacatattacagttactcctcaatcaacaagcattcggacaaccagccatttctgaggttaataaaacgccagaattactcgtatcacgaaaagaatggcagtatcaacgccaagacttaagacgacaatgtcacgcgttgaatgtaaaagtgaattgggaccaggatcttgaattaaatgttcagacatataccgaaacagcagaatgggactggaagaggccgctatacaagttggatctcgctcgaggattcttagaacgttgttaccaaccttccgatggaccatacttctatcagggcaaccacacctcaaggaaaaaccaagttaaatttttatctattaaaaacctgaaatcgtttgagagaagcaaagtcgggattgcaagagcgcttcttgataatcttaatcaaaatactactcgctatcttcgtaaatcagtcaaatttcatcaaagtcaagttgagcagtcgtgtcagctaaagcttgagaggaccgacgcgatttggaaacaaatagcaggctgttcgatcaatatttatccgcaggcgaatgattcattggctgcggaattggccaatcgaatgactgctgcactaaaacaaagtcaaatcgtgcaacaggtcaaggtaaatatccattgctcgcgaagttctcaatcgggacttaatattcaagtaattcgagatacacgcgatcacgcgaagtatgatcattatgaagttggaacagtagaccgcatcattcaacatgtcacggttgaaaaatttggcgcctatcaaaagggagatgaaggagttagttgggaaccccatgatggcaaaaaaagtcgagacgctgccactgatccagccttgattaagctagcgcaagagttatgtatcaaacaggatctagcgaataggcaattaacaatggtcgacgctgctttggctagaaaaattcagccgtttactttctatcgctttgaatacatacgcgaattgccagcgcctgaggtcatggttacaaaattagcatttactatgacaatgggtttggtgttttctaaaaaacaggtagtcctgaaggcggatcatcttaaaacggatgacgagtacacaaggatttgtgacaaagtctttaaagtgctgggctcaaaaaaacagaaatatatctgggatcgggttgattgtgtcgttcagtttggcaccaaacagattatgattcagcaatttgcccgcacaacgatgccggatggtgaacagataaagaaacaattagagctatgcaatcctaataaaattctttctcgaaaaaacgcaggtcaggagctggaaagggtgcgaccaatagatgctgatgatgaagcatttatgacggcgttcaagcaattacaatcggtggtcgcagaaagtcctagcacttttaatttaaaggatctggatcaagcggcgcgtgatgcagggctgaatccacggcaaccggggatgaggcaagtcaatcaattcttggaagcaaaagcttccttcacattgaaaagtacattgcaacgcaaccttccggattcgccgcttctagggttgaaatggatcggtttaacgagaattgaagagtggaacggttactctattgcccagtacttcgtgggtgccaatcaatccctaaagccggatattgcacgagctgtgacattgcgtcgtttattgccattgtcatacggtgataaggtcgttgatgaagtttttccggagttggctgctatgatgagcgttgaattcgtacgcaatggacagtatacggttgtgccgtttccggtaaagtacctgcgagaatattggttagcagaacagcgggagcatccggagtatcggtggaaaagattgccaagtgatcgatcatgatcattcgggaatgatcatataaatataaggaacgccagaaaccattgacaatgctgtcaaactctgacgttccttattttgagttgcggtttttaaaaattaatcttgcttactttgttgatagagttttaccgttgcgataaacccattgttacttcaacctagactacgaatgctaatgtttcctgtttttgagcacaattctcacttcatccacctgtttctatgacaacgtgccaacccatccaccacaagatcaatcgcccgccaataacgtttaaaagccgatttaggcaggtcgcggcgtgctttttgggacagaacttcaagtgccggtgccgcccaacgttttggcgtctcgatggcgtgggcgtacatgctcgcgtagaaagtagtcaccaatgcaataaagatgggcgtcggcatgccatagacgtgagatgtggttaaatctttcttgagttcgactaaatctaaagcaaaccagaatccttcttttgtgatacgctcagccgtcacggctttccattcgtatttaccgacctgagtcgcatgtggtagtccttcgggtcgtttcatggtcataaagtagtcgtctctgcggctgattttgagtccccgttcagcagcgtacttcacttcgggcaggtcggctggttgatcgaaacctgcgatgacgttcaactgatcaatatcgaaattttcagcagtcatcgtaacaccatgttgttgaccaagcttttgaacgccggtgataaaagccccgggatcttttaggtgcggttgcacattgaaagttaaaaagatttgaatagtggcggcgtgtgtcgcgtaagccactggatctttgaaaaaaggcgttagctgatcttccatgacagttagtatccgattgatgtcagtccatccagagggactgtggccggtttgcatatacatcgccgtaccgaacttttccaaagtagcttcgattgtatcaggatcaacgaaaggcagaagtttctccggaataggtgagttcacgaagttttgaatgattatttgggtgtttttaagcggtttttgtgccatctgcataatgtctttttttaattactgtttcgaattttgatatatgatttgaacgaattagaaaatggctttacttataggtatcataaggtaagatcgtttgcgatacaaggttatttgtagctggcattattcgtttgtttgctaatgggagactctattatctgaacggtaagcaaagacgagcgcatactgccgagcgcttggcgagacacatgacttaagcgcgaaaaaggaagccaatttgctggcttcctcaaaatatgctttttccaatttcaacaaaacgagacctagctaaaccaaccgtgcaaacttaatcaacgttcgaaccatctgacaggtaaacccatactcattatcgtaccaggcaacggttttaaccaattgtgtgtcgcctgccgtaacgacttcggtttgacttggatcaaagactgagccaaaagtggtatttacaatatcgcttgaaacaattggggcatctgtccagccaaagctttcgttgttgatcgtgtatggcttgatatgctcattgacggtatcgacggtgaggtctttggtatgcagaatggtcaccaattcggtcaaagaaccatcagtaacagggacgcgttgggcatgaccttgcagtttgccgtttagtttgggtagcacgagcccaattgccttggcagcaccagaagaatgggggattgtgttaacagcggcagaccgggcggcacgcaaattaccgccgcgaacaggtccatcaagtagcatctgcgttgaagtatacgcgtgaacggttgtcatggtgccaacttcgacaccgaattctttgtcgagtgcatctgccattggggctaaacaattcgtggtacaagaacctgctgaaacgattgtgtcactgttagtgagtgtattatcgttaactcgatagacgattgtcttcacgtctttacctgcaggcgctgaaatgaggacccgcttaacccctgcgttcagatgcgcctgggctttgtcttttgaagcgtagaagccggtacattctagaacgtaatcaacgccgtcatttgccacccatgataatttttcagcattgggttcggcgtaaacatgataagatttgccatcaacgcgaatggcattttcggttgcggatatctcagcattcaaagtgccgtggcttgaatcatacttcaataaatgggctagcatggttggcgaggtcagatcattgatcgcaacgacctcaatgttcgcggttggaccaacttcaagtatccgccgaaaagccaagcgaccgattcggccaaaaccattaattcctatttttacagtcataatgcttcctccttaagcgtgttgattgtcctagaaaccgggacaactcacgctttttcttgttgtgtcatctgactacgcatatagtatggagcagaggctggtacacaaccagaccatggctatcctaggataagctgtcctactttgaggtgagcaaaatgaatgagaaggttttggggcattttttgagatataaacggacacatgctgatcgggcaaagtttgatgtcccggatattaagcatcgcacgcctgggttaacgcgggacgaggttgctacattggccaatgtcagtacagattggtatatccgcattgagcaaggaagaactggcgtatctgcttccgctgatgtactgagagatctttgcaaaactttgaagttgaatcaagcagaaacgaattatattttcaatttggccgaggaaatcccgccaacgactgaccaatcgacttcatatgacagtgtgcagcggtttgttgacgaacagatgccaaatcctgcttttgcgcttgatcagaatttaacggtggtagcagctaacaaaatgtatacggctatttatggcaactttttagccgagagtgcgttgcgacgtcatttggtttttcgcacgttcaatgatccgcattttcgtgctgtcatggttgactgggaaaattatgccagtgcgcttacggcaaagtttcgccaattatatagtcgaacgccggattcaaaggtcttatttgaagtctattccgcggtgaaggatgatcccgtttttaagcaaacgtgggatcagctaaaggtcgaagagttaggagaagaacggttgctgctcaacgttcctaatgcatacgaactctatttgattgagacttttctgaagcttttgggggctggcgatattatcggcgtgcaactgccaggggatgaagaaactcgaaagaagcttggcgagatggttaacgactaaaaagtatgtgactgagcgtaccaacaagtcttttgtagctatcgaggttaaaaacaggcagttgttacttttcacataaatacagtatgctagtcgttaggaaatagttcatactgagattttaattgtcttagtactaaaggagttacacaaatggcacaaattcaatggtttcctggtcacatggccaaagcccggaaacaagttcaagaaaagattaaacaagtcgacctcgtgcttgaagttgtcgatgcgcggacaccggaatcgtcgcgcaatccgatgttggatgagctggtggctgacaagccgcgcattatggtgctgaataagcaggatttggctgatccggcgttgacggcggcgtgggtccaatattatcaggatcaagggtttgcggcgattgcgattgatgcccagcatgccaagcggttgcagcaaattccgcaattggcgacgaagttgatggcggaaaagattgcccggaaaaaggcgcgcggcattcgtaatccgatgattaaggcgatgtgtattggcatccccaatgtcggcaagtcgacggtgttaaatcgtctggttcggcgtaacatcgcggtgaccggcaacaaaccaggcgtgacgaagaatcaacagtggttgaaggccagtgataactttcaattgcttgatacccctggaattctttggccgaagtttgcctcacaaacgattgggatgcggttagcctttacaggtgcaattgccgatgcagttttccaagaagacatggttggcttgtatgggctgacttattttatggcgcattatccagctgctttgaaaaaggcataccatgtcaccgaggatgatttaaatgaagcgccccatgatctgctggttaagttgacgaaatcacaaggtttcgctgaggcttacgatcggatggctgagcgcttgatttttgatgcacgacaaggaaaattgggacgctttaccctcgagaagcctggtgagacagatgccgacgctgagtgagtataaagcgttgctggctgctgacgaagttgcaccggctattttggcggcacttaaagaagacagtcgcatcggtgctggcaaattactggcagcgtatcaacggcgaatggcccatcaagcagctgaagaggtggctttacgttatcgtagcaggtatgagcgtcagttatggggaacctatgagtatgtcgctgggttagacgaagtagggcggggaccacttgctggccctgtcgtgacggcggcggtgattttgccgcaccatttccagtggccggtgaatgactcgaaacagctgaccgcacatgaacgcaatgtgctttacccgcatattttaactgaagcgattgcagttggcattggcgtggctgataatcggacgattgaccgtgaaaatatttaccatgcgactgaattggcgatggctcaagctgttgaccatttgcgagtcgctccggaatgtttgttggtggacgcaatgcacgtgccagtcgacttaccgcaaaaacgcttaattaagggcgatgccaacagcatcagcattgctgcggccagtattgttgctaaagtgattcgtgatcggcttatgatgatgtacgataaaatttaccctggttatgattttaaggacaacatgggatacgggacaaaggcacatcttgccggattggcggcgcacggcgttaccccaattcatcgccgcagttttgggcctgtacgtgatcgactgcgctcttagtgcttcattgagtgtgtcgatgtcgtgtttgcgtagtttatttgcgggaggacgaccaacaatgacactgcgcaattttttactagcatggcacattgccacatgccagaatccgcggatggcagttgctttagaacaagctatccgaggaaaagatgatctcgcaccgtttcaggcagagctcaagaagcgtttgactgaccagtatagtcaacaattaattgctgccaaacacgtgccgtttatgacgtatgttgatgctgcttatccaccacgattgcgggaaattccgcaaccgccgttggtgcttttttatcgtgggcagttaggtctgttgaatcaattaacgttagggattgttggttcgcggcgtgcaaccggctattcagcaacggcgctggcgcagttattgccgcaactaccgtcaatggtgattgcaagtggactagcagcaggcgctgatgcgatggcgcatgaggcagccctcagtgcccgactgccaacgattgcagtgattgccaacggccttgatcaggtgtatcctgccaagaaccgcgatttgcaggtgcagattgcgcatgttgggcttgttttaagtgagtatccaccagcaaccggcccgcagcggtttcaatttgtcgctcgcaatcggattattgccggtattgcccatggtgtgatggtaactgaggcggagatgaaaagcggcagtctcatcacggctaactatgctttgcaacataatcgcgaagtttttgcgttgcctaatcgaattgatgcgcctttgggagcaggtacaaatgcgctgattcaggcaggagcggcgttggggactggtccagagacgttggtagaaaacttgaatttttacccttgaggtgcacatttttgcttactttatagtagaaaaaatttcttttgatttgacaagagcaaaatgactagcttatgatagcaactgttttgagtcagcaggtggcattgaccattagactggcaccagttgcgattgctctgatggtcgcaccgttggcagatgatctattgccgccttaggacgcatcaattactgacgacgaatcgtcagcatcgcacaaattaatcagggcttgcttactaggcaatgccaccggaaggagcgcgttcatggccgacaagaagttagtcattgttgaatcgccagccaaagccaagactattgaaaagtatcttggccgaacctataaagttgttgcaagtttggggcacattcgcgatctacctaagagtcagatgggggtcgatgtcgataacgactacgagccaaagtacatttcgattcgcggcaaaggcgatgtgattaaatcccttaaaaaagatgctaaaaaagctagcaagatttatctcgcagccgatccggatcgtgaaggagaagccattgcatggcatgtcagtcacattttaggtttggatccaaaagccaaaaatcgcgtcgtttttaacgaaattacgaaagatgccgttaaaaatgcgttcaaaacccctcgtggcattgatatggatcttgtagatgcccagcaggcacggcggattttggatcgactggtaggctattccatcagtcctttattatggaagaaagttaaaaaaggcctgagtgctggccgcgttcaaagtgttgcgctaaagctgattattgatcgcgaaaatgaaatcaaaaacttcacgccagaagaatactggtcattagacgctgagttccagaagggccgtagtaaaaagttcagtgctagtttctatggcctgaagaataaaaagcaggctttaaagaacaacgaggccgttcaaaagattttgggccaagtggacaaaactaagccgtttgctgtgacgaatgttgttaaaaaggaacgcaaacgcttcccatccccaccattcacaaccagtaccttgcagcaggaagctaaccgtaagttgggattccgcacccgaaagaccatgatgttggcccagcaactgtatgaaggaattaacttaggtggtaagttaggcaccgttgggctgatcacgtacatgcggaccgactcgactcgcgtgtcaaatgttgccaaaactgaaaccagccattacctgcatgagaaatacggcgaagcttatgctgccgtcaaaattcgccaaggtaaactgcaggaaggggcacaagatgcccacgaagccattcggccaaccagcacattacggacaccggatagtttgacggcagttttggacaaagatcagatgaaactttatcggctgatctggagtcggtttgttgccagtgaaatgaccccggcgattattgacactgtggccgtgacgttagaccaaaacggtgtgactttccgcgccaacggtagtcagactaagtttgaagggtttaccaagttgtatgtctcatcacgtgacagcgatcaaaaggacaatattttgccaccgcttgcagttggtgatgatgtcaaaatgttgaagaccgatccggctcaacactttacacagccaccagcccgttactcggaagcaaaccttgtcaaagcgcttgaagaaaatggcgttggtcgtccgtcaacttatgcgccaactatcgaaaccattcagaaacgttactacgtgaaactgaatgctcgtcggtttgaaccgactgaattaggtgagatcgtcaacagcttgatcgttgaattcttcccggacatcgtgaatatcaagtttacggcgaacgtcgaatctgaacttgatgggattgaaaccggcgaggctgattgggttaaggtgattgatcagttctataagccatttgaaaaagaagtggctcacgccgaaactgggatcgcgaagattcaaatcaaagacgaaccagccggcttcaactgtgacatctgcggtgcgccgatggttatcaaaatgggtcgctatggtaagttttacgcctgttcccgattcccggattgccgcaacaccaaggccattgtcaaagagatcggggttgtctgcccgaaatgtcatatcggtcaagttgttgaacgtaagagcaagcgtaaccgcgtcttttatggttgctcgcgttatccagactgcgactttgtctcatgggacaaaccagtcggccgtgattgcccagtctgcggacatttcttagttgagaaaaagagcaaagctggcacccaagtcgtctgcccaaataacgattataaagaagccttacaaaaagcataatttgagaaagcagtgagtatgttatctttgtactcactgtttttttcgggtaaacttgggcagagcgcgaacaggcgcgcttagaaaccggagcctaagtggcctcaagcctaaatggctgggctttggccatttaggcttgaggtccttatgtgcaggtttctgcgcctgtttgcgcgtttcggaactggagcatcaccagccttaaagtctaaatggctgaactttggccatttagacttcaaggtccttacacggatgtttctgcgcctgatcgcgcctttagaaagcttgctcaaagattcagtctgcccacaatagcaagctgagtcgctaccacatcagcaagcccccaaaatacacatgccgcaaaactcacattttctctgaacgaactaattgcgccacgccaccacaaggaggaatcactcatgccaacagttaatgtcattggtgccggactagccggatcagaagcagcctggcaaatcgctcaggccggtgtagatgtcaacttatacgagatgcgtcccgctaaaatgacacctgctcatcacacgagcaattttgctgagcttgtctgcacgaattcactgcgcgccaaccagatcaccaatgcggtgggtctattaaaggaagaaatgcgtcagttacattcaatcattattcaaagtgctgacgccaccgcagtccctgctggcggtgccttggcggtggatcgcgaaccatttagcgagctagtgacccaaaagttgacgagcaattcgcatattcatgtggtgaatgaggaattgtcagcatttcctgatgggatcacagtggtggctaccggtccgctaacagcgcccgggctagcacaggcaattgttgatctgaacggcgaggccggtttgtcattctttgacgcagccgcaccgattcttgatgcgaatacgatcaacgaggacattgtttataaaaagtcgcgctatgatcgtggcgaagccgcctatttgaattgtccgatgacgaaggatgaattcttgacgttctatcaagcgctcgtttctgccgaagttgctgaaggccatgattttgaaaagatgacggtttttgaaggctgcatgccgattgaagtcatggccaaacgcggtattaaaactatgttgtttggcccgctaaagccagttggccttgaagatccacggacaggtaaggaaccttacgcggttgtccagttgcgtcaagataacgctgcagcaagtttatataacatggtcgggttccaaactcatcttaaatggggcgagcaaaaacgggttttccgactaatccctggacttgaaaacgtgcaaattgtccggtacggcgtcatgcatcgcaacactttcatgaaatccccagtggttttggaaccaacatatgcatccaaacgccggcctgatctgttctttgcaggccagatgactggggtggaaggttatgttgaaagcgccgctagcggtctgattgcgggtaccaatgcggcccgtatggcgcttggagaaaccccgctgatttttcccgaaactacagcgatggggtcaatggcgcattacattactcacacatccgcccatcacttccagccgatgaatgcgaactttggcatcatgccagcgttaacagtcaaagtacgcaataaaaaagaacgcaatcagcagttagctgatcgtgcattaaaagatttagctactttccaagcaggtatgaatcgggttgaacaagtttaaggacgcaaaaaatctcgggttaccgggattttttcattggtatttcggcggcttgatggtgttgatgcactgaaagcgtcaacaatggctgcattttatgttaatgtattatcggagggattcaatgaagccaattgcagcgtttcaagagtatcttgaagttgaacggcagtattcaccggaaacagtgacggcttatttgagtgatcttcaagaatttcaggcgtttctcaaggccaacggcgggtttactgactttcggcatgtggatgatttagacgttcaaacttatttgactgatcttaacaaacaggatttggcacggacatcgattgcccgaaaaatcagtagtttgcgaagcttttaccgttatttgacacgaattgatgtcgtcaaacgcaacccatttgagctggttgaattaaaaaagcagcatcatcatttaccacaatttttctatgaagccgagattcaggaactgttcaagacagttgctggcaaaaccccgctggatcaacgtaatcgcgctttgttggaagttttgtatggcaccggtattcgagtttccgagtgtgccaaactgacattgaatcaggtcgatttcaatacggcattactgttgattcatggtaaaggcaacaaagataggtatgtgccctttggacagtacgctcagcaagcactacgaacttatttaaaagatggccgacaagtcttgatggctaaaagtcaggcacagcatcgatatgtatttgtgaaccagtatgggcgtccgattacctcgcgtggcattgaatatattttggatcagctcatcaagcagacgacgctgacagccaacattcatccccacatgctgcggcatagttttgcaacccatatgctggatcatggtgctgacctgcgaactgttcaagagctactgggtcatgcaagtttatcaaccacacaaatctacacgcatgtcaccatggcacatttaaaaaatgagtatatgaaatattatccgaagcataattaagactaaagcatgatgcaaaagcagtctgagttttttaagctaagaacattggcgataacagattaatcgctactttagctgtttttatccgacgagatacgcagataacgcgctcgcagtcgcagaaacctacataatgacctggaagcctaaatagccaaaattcagccatttaggcttccagcccacttatgctccggtttctaagcgcttctgctcgcgctcacttaaaaaggagcatgactatgacaacaattgcagcagtaagaaaagatggtgtgaccgctttggccggtgacggtcaggtaacccttggcgaaaaggtcatcatgaaaggcaacgcgcagaaagttcgccggatctatcatgatcaagtcgtcatcgggtttgccggcggggtggcagatgctttcaccctgcaagactggtttgaaaagaagctggagcattatgcgggcaacttgcgacgttccgcagttgcgctggctcaagattggcgcaaggatccgaccttgcagaaacttgaggccatgatgatcgtgatggatgagcatgacctgttactcgtatccgggtctggcgaagtgatagatccagatgaagacgtggtagcgatcggctccggcggcaactttgcgcaagccgcggcaatcgcgatgctgcggcatgccccagatatgacaccagctgacattgccaaagaagcagtgaatatcgcagggaatatcgatattttcacaaaccacaatgttattgtcgaaagcttttagtttgtaaccgtcggcaattacattgacctacaggaggcttatgatggcagaagtacaaaccccaaaacagatcgttgaaaaactcgatcaatatgtcattggacaagatgatgcaaaacgggccgtcgcggttgccttgtataaccgttatcggagaatgcaattatcgccaaaaatgcaagaagagattaccccgaaaaacttactcatgatcggaccaaccggtgtcgggaaaaccgaaattgcacgacgactggcgaaaatagttgaggcgccatttgtgaaggtggaagcgactaagtttacggaagttggctacgttggccgtgacgtcgaatccatggtccgagatcttgccgaaactgccgttgccatggaagaagagaagcaattttcaaaggttcgcatacgtgccgaaaaagaagccaataagcgtttggttaaaattttagtgccggccattcgtaaggaaaagaataccaatccgatggccgagatgatgagcatgttgcaaggaatgcaaaatggcaaaatgccagctggcgatgatgcagacgcaggcggcgaagtgaccgatgatattcgcaataagcgtttaagcgtggcagagcaactggaaaaaggattacttgaagatcatgaaatcaccgttgctgtcaatgatgagaaaaaaggcggtggcatgggtgacatgtacggtcagatgggcattgatctaagcgacaccattggcgctttaatgcctaagaaaaaggttgagcggaccatgaccgtcaaagaagctcgcgaaatcttcatcaaagaggaatctgacaaactggtcaatcatgccgacatctatcacgacgccattcaaagtgccgagaataacgggatcattttcatcgacgaaatcgataaaattgctgcgggaaacaagcataatagcggcgaagtttcgcgtgaaggtgtgcagcgagatattttaccgattgtagaaggatcgcagattaacactaagtatggtcctatcaatactgatcacatcttgttcattggctcaggtgcgtttgccgaggctaagcctagtgatttgattgctgaacttcaagggcgttttccaattcgggttgaattgaaggacttaaccgaaaaagattttgtgcggatcttgaccgagccagacaatgctttgatcaagcagtatatcgccttgattggtgcagatggcgtgaagatcaccttcacgaaggaagcggttgatcgaattgcagagattgcgactcaggtcaaccacgacactgataatattggggcacggcgactggcgaccattcttgaaaaactgcttgaagacgtactttatgaaggtccagatatggcgatgggcgctgtgaccgtcacccagcaatatgtggatgataagattggccatattgcggctgattcaaacatgacgcggtatattttgtagttaacaataatgttgtaggtaaaggatgaggatgtatggtaacgattgcaaatgactttttgacagttaaaatcagtcggcatggtgctgaactgaccagtatcaaagataacctgacaggcagggagcgtctgtggcaagcagatcctgcggtgtggggtcgccacgccccggtcttgttcccgattgttggggcgctggctgacaatcaatatcattacgcaggcaagacttaccacatgggccagcacggttttgcccgtgatcgtgatttcacggtgctctctgcgacaccgtttaaagcgagcttcgttctgaaggatgatgacaaaacgcgggcgatgtacccgttcgcttttcgtttaatcatcacgtttgcactagaaaataacaatctacatgtcacgtatcacgttgacaatccggacaaaagtgagccactgttctttagcatcggcggccatccgggcttcaaggtcccaatgacgccggatactcaattctccgattattatttgaacttcaaaccgcgtaagtcgcttgttcagattccattggttgctggtgaaggcattgattacacgcaccggaccttggctgcaactgatgccaatttggccttaacgcacgaaacatttgatcatgatgctttaattttcgcgttgcttggtaagacaaccttcaacttggtttctgacaagacgaaacatggtgtcagcgttaccatgaccgataccccatatctgggcgtttggagtccgtatccaaccacgggcgactttgtctgcatcgaaccttggtggggcatcgccgacacgattggcagcactggcgacctgacgcgcaaactcgggatcaatcgacttgaacctggcacggcatttgagaagggttacatgatcagcattttctaaggtgtcatcagtttgtcgattaggtacatgaaaaaagacatccagtttcggatgtctttttggttgccatcaaaaggtgactaagagcggccccggtgttgacgaagatattggcctaagccaaagggcaccatattttcatctccggccttgatgcgtttgaagtttgcccgatgtttgatcaaaaagacaaccagcaacccgcaggcaacagttgtcagcaaccaatcatggtaaacaagcgaccaagctgtgatcaacaccatacccagtgtgctggcaacgctgaccatggacgttagcaagatcaaactaaaccagatggcaaatgcaatgacaaaaaatggcggattatatgcaagtaaaatgccagcgctagttgccaccgccttaccgcctttaaagcgaatgtagatcgaaaatgtatgaccgaatacggccgctaaacccacgatcagcaccagccaatgatgctcgatgccaaagagaatgggtaagctggcagccaacgtgccttttaagatatccagcaccaagacaattgagccgccgactggccctaacatgcgataagcatttgtggtgccaatattgtgactcccgcctttgcggatatcggtgtgataaaagagtttaccaatgaccacaccaaacgggatggcgcctatgaaatacgcgagtataaaacaaagcacaagtatcaaatgtgcccctcctctcaaactagaaactattttagcatttttgacttttgagtgatacgtcagtagaataaaacgaacgtacattcgaataaaacctgtgaagcgggttgtggcgcgatttggtgttgtcttgcgcaaggatcatggcggggcacagcgtagatatggtgccagcgggcgatgaatttcacgtcaagaagtcatagttatgtgccatgcttagggaagtgcggttttctgctgagctttgggacattgacacggctaataaaatttaaatgaacaatgatggtattagccagctgggtcgattttgaggagaaaactggagtcctgagagcaatacggtgaggtctggtgttgatgcctaaacgcgatcaccagcccagcaacctgcgtgtaaggaccttggccgcaatggtcaaagcccgaccatcacgtccaaggccgcttacactccggttgctaaccgctcctgctcgcgctctactgaaacgcgttcaccagcccagaaacctgcacataaggaccttgggcacaatggtcaaagcccaaccatcgcacccaaggccgcttatgctccggtttctaatcgggctgctctattgaaacgcgctcgcagtcgcagcaacctgcgtgtaaggaccttggccgcaatggtcaaagcccgaccatcacgtccaaggccgcttacactccggttgctaaccgctcctgctcgcgctcttattttttatttctgaaatctcaacgcgtggtgtattctataacttagttgttcaaaaaagggagtttactatggataaagcaacgcaagcatataatgattcatccattcaggtgctgcatggcttggaagctgtgcggaagcgtccggggatgtatattggttccaccgatggccgcggtttgcatcacttggtctatgaaatcgtggacaactctgtcgatgaagcgctcgcggggtttggggatgagatcaatgtgacgattcacgccgataactctgtgaccgtacaggatcatggtcgcgggatgccaacggggatgcacccgagtggcaaaccgacgattgaagtcattttaaccgtgctacatgccggcggaaagtttaaccaaaatagttacaaaacttctggtggtttgcatggggttggctcaagcgtcgtcaatgccctatcggagtcattgactgtgcgagttgtgcgggataagcacgcatttgaggagcattttatcaatggcggtcatcctgatggcagtttgcagaagttgggcaaagttaatgaacctaatggcacgaccatcacgttcaagccggacccgactatttttcaaaccaccgtcttcagttatgataccttggccgaacgcttgcgcgaatcagcctttctactgaaaaatattacgattaatctgactgatgaacgcaccggcaagcatgacagttaccactatcctgatggcttggtcagttttgttaaataccttaatgaaggcaaagacgcattgtcacaggtgatcaattttgaaggcaaaaaggacggtatcgtggttgattttgccggccaatataacgatggctattctgaaaacctgatttcgtttgttaataacgttcgcactggtgatggcgggacgcatgaaattggcttgcgcagcggcatgacccgtgcattcaatgaatttgcccgaaaagtcggcttgctgaaggaacgcgacaagaaccttgaaggcagtgatgtgcgtgaaggttttgcaggtattttaagtgtccgcattccagaagaaattttgcaatttgagggccagacaaagggtaagcttggtacgccgcaagcccgcactgtggtcgatgggattgtctatgacaagctgtcaacttttttgatggaaaacggtgaagagtcgcaagagttggttcgtaaagccgtcaaagcccgtgatgcgcgggaagcggctcgaaaagcgcgcgacgatagccggacgggacgcaagcgcaagaaggaccaaggtttgctttccggtaaattgaccccggcgcaaaccaagaaccctaagcgtaacgaattgtatctcgtcgaaggggattctgccggtggttcagctaaacaaggccgagaccgaaagtttcaggcgatcttgccattgcgagggaaagtactgaatacccagaaggccaagttacaggacatcgttaaaaacgaagaaatcaatacgatgatttacaccatcggcgctggtgtcggtgcggattttgatctgcagcaggccaactacgacaaaatcattattatgactgatgcggatactgatggcgcgcatattcagattttgctactaaccttcttttatcgctacatgcggccgctgattgacgcaggccgaatttacattgctttgccaccattgtatcggctgcaaaaaggcgctggtgctaaaaccaagatcagttatgcttggaccgatgaagagttggccaaagagaccaaggccatgggcaagggttacacattgacccgatttaaaggacttggggaaatgaatgccgaccagctttgggaaacgactatgaatcctgagacgcggactttgatccgggttcggattgacgatgctcagctggcggaacgacgcgtgaccactttgatgggtgatcgcgttgagccgcgtcgtgaatggattgagcataacgtcaagtttgatatggatgacgacggcagtattttggaaaccccgactgctaatcacgaaaaattacagtttggtgccaagcaaatcgtcaaacaactggacaagaaaggaaagtaaaagccattggccaatcagattcaagaactgaccttagaagaggtcatgggcgaccggtttggccggtactcgaaatacattattcaagaacgggcgctgcctgatgtgcgtgacggcctcaaaccggttcagcgtcgcattttatttgcgatgaaccaagatggcaatacgtatgataagggcttccgcaagtcggctaaaagtgtcggaaatgtcatggggaattatcatccccacggcgacagctccatttatgaagcgatggttcggctgagccaggattggaagttacgggccccactgattcagatgcacgggaataacggttccatggatggtgatccgccagctgcaatgcgatatacggaagcgcgtttaagcaaaatcagcaaggaaatgctggccgatatcgataaggaaaccgtcgatatggtgttgaactttgatgacacggcacaggaaccaactgtgttgcccgcaggatttccgaatttgctggtgaatggtgcaacgggcatctctgcaggttacgcgaccgaaattccgccgcataacttgcgcgaagtgatcaatgcggtcttatacttgctgaagcatcccactgctgatttagatactttaatgcaatacgtcaagggtcccgattttccaacaggtgggattattcaagggcttgatggtatcaagcaagcttacgaaaccggccgcggtaaaatcgtggttcgttctcggacacacatcgaaaccattcgtggcggtcgtgagaagatcgtggtcactgagatcccgtatgatgtcaataaagcgcagatgattaaaaaaatcgatgaattacgcatcaacaaaaaagtggacggtatcgccgaagtccgtgacgaaagcgaccgttttgggcttagcgttgtcatcgaattaaaaaaagaagccgatgcacatggcatcttaaactatttatttaaaaataccgatctgcaaattgcatacaattttaacatggtcgctattgccgacatgcagccgaagttactaggactcaaggccatgttggaagcatacgtcgaacatcgacgcgatgtggtcactcggcgaacgcgttttgacctcaacaaggccgctgctcgacagcacattgtcgaaggcttgatcaaaatgctatcgattttggatcaggtcatcgccgcgattcgtgcttccaaggataaaggagatgctaagcgtaacttagtcaagaagtttgatttttcggaagctcaggcggaagcgattgtttccttgcagctgtatcgattgaccaataccgatatcacggctttacagaaagaagcagcacaattggcgaaagcaatcgccgagtatcaagatattttggctcgccccgctgcccgcgatcgggtgattgaaggcgagttgaagcggattgccaaggagtacggggatgatcgtcgcagcagcattcaagccaaaattgaaacgcttgaagtggcgacaacggtgacggtggctgatgaaaccgtcatggtgcaggtttctcgtgatggctacgttaaacgcagttcactgcgcagttatcaggcggttgatccggccgacaatggtttgaaggccaatgatcttgccattttcactggcgaactgagtacgttgcagcatctttacatcgtgacaaatgccggaaatgtcatttatcgaccagtgcatgaaattagtgatgcgcgttggaaagacaccggcgaacacttaagccaaacagttggccttggcactgacgaaaaagtcttggcagtgtttgcttttgatcaactcgatggcgctggcagttttgtgttagggtcaagtgacgggtacatcaaacaaactgccttaagtgatttgcagccgcaacggacgtacaagagtaagccgatgatggcgatgaagctgaaagacccagccgcgattgtcaccaatgcatacttcacgactgatcagcaacaggatgtctttgtggtcagccgccacgcttacggactgacattcccgttaagcgatgtgtcaactgtcggtgcccgggcaaccggcgttaaaagtatggatctaaagccagacgatgaggttgtcaatttcattctagtgaaggatccaactacggctaaggtcggtattttgacccaacgtggcgccttcaaaaagatggccttaagcgaggtcggggaaatgagtcgtgcccgtcgtggtttactggtcttgcgtgagcttaagcgtgatccgcatcggattgtcgcgatgatgtcagtcgatgacgctacccgcctgaatgttttgaccgatacgggtaaggtaacgacccttaatccggcacaacatccagcaggtgaccgatattcgaatggttcgtttgtcattgacactgatgtccttggcaagccagtttttgttcaaactaaagaagaaccagcagatcaagtcgaataaatggtgatcattgacgccgccgtctgtactaatacagatggtggcgtttttgattattataggacagatcagttgtgcacaatttaacaaaatgccgaaatcatgggcgaaaagaagcgacgaagcacacttaaaaaacaatataacgcctattatatgggcaataaaacgcttgcatagatttggcggcgtgttatactgtgtttgtaagaactgtcacatctgtaatccactttaggaggcaaacaactatgaaacagcttgacgaaaccaaagttcctaattattgggaaggctttaacggcggcgactggcaagaagaaattaatgtgcgcgattttatcgagcataacctgaaccaatatgacggggacgaaagtttccttgctggccccactgaagcgacaacagtcctgaacaatcaggttctaaatttaaagaagcaagaacgtgcaaatggcggtgttttggatgctgacaacaatattccatctacgatcacctcacacggccctggttatttgaacaaagatcttgaaaagattgttggtgttcagaccgacaagccattcaaacgagcattcatgccatttggcggtattcgaatggctgaagatgcattggaatcttatggcttcaagacagatcctcaagaacacaagattttcaatgaatatcgtaagacccataaccaaggtgtctttgatgcttatacccctgatatgcgaaaggctcgccattacaagatcgtgactggcttgccagacgcatatggtcgtggccggattgtttctgatttcccacggatcgctgtttacgggatcgatcgtttgatggccgagaagttcaaggattataacttgactggcgacggcgaaatgactgacgatgtgatcaaactgcgtgaagaaatcaatgaacaatatcgtgccttaaacgacatgaagaagatggccaaggaatatggctatgacatctcgcgtccggcagctaatgcgcaagaagctgttcagtggatctactttggctatctggctgctgttaagactcaaaacggtgccgcaatgtccgttggccggatcgatacggttattgatgcttatatccaacgcgatatgcgcttaggcaaattgaacgaagaacaggcacaggaactgattgatcatttggttatgaaattgcggatggttcgtttcatccggactgaagaatataactcactgttctcaggcgatccaatctgggcaaccttgtcattggcaggaatgggcaatgatggccgtcaccacgttaccaagacggctttccgtttcctgaagactttggacaacatgggcgcagcaccagaaccaaacatcaccttgctttggagcgaacgcttgccagaaggcttcaaacgctatgcaaccgaagtatccatccaaagttcaaccattcaatatgaaaatgatgatctgatgcgcaacgaatggggtaccgattactacggtattgcttgctgtgtctcggcacaaccaattgctgatggcgttcaatactttggtgcccgtgctaacttagctaagacagttctgtatgcgatcaacggtgggaaagatgaaattcaggaagcgcaagtagggcctgaatatgcaccgatcaccagcgattacattgattacaaagaattcatgaataagttcgacaagatgatggactggctggccgacacgtatgtcaatgctttgaatgtgattcactatatgcatgacaagtattattatgaagctgcacagctggcattgaaggatacccaactgaaccggaccttcgcaaccgggatttccggcctgtcacacgcagttgattccatcagtgcaatcaagtatggtcatgtcaaggcaattcgcgatgaaaacggtgttgcagttgacttcgttgctgacaatgatgactatccacgctatggtaacaacgatgatcgcgctgatgacatcgctaagtggttggttaagaccttctataacaagatgaacacgcatcatctgtatcgcggcgcgaagttgagtaccagtgtcctgaccattacttccaacgtggtttatggtaagaatacagggacaacaccaaacggtcgtcaaaaaggcgaaccattctcaccaggtgccaacccggcatacggcgcagaaaagaacggcgcattggcatccctgatgtccaccgccaagattccgtatcattacgcaactgacggcattagtaatacgtttggggttactccgaacacactgggccacgatgatgaaactcgtaaggataccttggttcacatggttgacggctatatggaaaacagcggcatgcatttgaacatcaacgtcttcaacaaggagaccctgattgatgctcagaagcacccagaagaatacccaacattgaccgttcgggtttctggctactgcgtctacttcgcagatttgaccaaggaacaacaagacgatgtcattgctcggaccttcttcgaagaaatgtaagcagcttaactcaagacaggaagtcattcctgttttgccaaaagacggcaacgatgctgttgccgttttttggcagaatgaaatgaaaatcaattgaaaacgacacatgatgttgtagtggaggcaataagatgaaactcatcgatcagtcacaaagcccattaaatatcttagaacaagttggtcaggatcatgatggcccgatcaaagggtatgttcactcggtcgaaagttttggttcggtcgatggccctggtattcgcttcgttgtctttatgcaagggtgtcgcatgcgttgccagtattgtcacaaccctgacacctggaacattggggttggtgaagaaatgacggctgatcaaattttggcggatgcccagcgctataaagctttctggggtgaccaagggggtattacctgcagtggcggtgagagtttggtacaaatcgatttcattctcgaactcttcaccaaggctaaggcactgggaatttcgacttgcctcgatacgtcaggcggccccttcacgcgtgaccaaccgtggtttggccagtttgaaaagctgatggctgttactgacatctcattagttgatataaaacacattgattcggccgagcataaaaagctcaccggttttcctaatgaaaatattttggatatggtgcagtatatgtcggcgcatggtgatgacatgtggattcgccacgttctggtcccggaacgcactgactttgacccttatctcaaacggttaggggactatattgcgacattggacaaaaacgtggtccaaaaagttgagattctgccgtatcacacgttaggcgttaaaaagtatcacgagcttggcattacgtacccgcttgaaggcatcgaaccgccgtctgccgatcgcgttaagaatgcagagaatctgctgcacgttaaggattataccggatggcaaagctggagtccgaaaccagttgcgagcaactgaatttttagctagaacttaacgtaacgattaaaaacgcggcaaattcgttgcgttttttttcattgccacttatgatgatggttgaacgatattattaaattataaacgaaagggaagccgccctatgaaaacgaaacaagagcgcattttttcctcaaagacactaacttattttctgcaattggcagaaaccatgaactacacccaagccgcccaattgcttggcattacccagccagccttaacacagcagatcaagaaattggaacggacggtgggggcaccgctgttttattctgtcgggaagaaactgcatttatctgacgctggtcagaccatgttaaagtcaacccatgagatctacgagatcttaaaccagacaaccgacgaaattcaacaaacaaccagtgcaaccgtcggaaaaatcaatattgggttattaagctcaattgaggacagcgcctttattgcgttcattgctcattactatcaactgaatcctgaagttgaagtgacgctacggatgatgacccgtcacgaaatttgggaatccttggaaaacaaccagattgatttggctatcatgaatctgccagatgagaccattaagaactggaaaccatacgccagcaagaaaattattgatgaacaattgctgttcttgcaccacgatgacgccttggctaaccgtaagcgaatccatttcaaagatactttagctgaaccttgggcaacttatcctgacgactatttccttggacagcttctgcgtgaggcgtacaagaatcaaatggttgatttcccgcacgtggtcgcacatttcaccacgccatatcagttaacccaattcgttaacttgtcaggggtcaacacggccttaccaaccagttttgttcgggcacgcgctgatcaaatcaaggcctatgctattgcgtttgatccggccattcgctttgagatttcttttgtttatcgcaaagagaaagctgacattccgcggatctcgaacttcttccagacctttgacgattatctgaaggaaaaagattacttgtcgcgggtcagtgaaaaccgtgttaaacttgataagtaaactattcagttgaggagcgatcagataagatgacgactttgatttttgggcatcagaacccggacaccgacgcgattacgagtgccatgagctgggcagaatttcagaaacaggcaggcaacacggatgttgaggcggtagcattaggcgaaccgaacgatgaaactaagttcgtccttgatcacttcaaggttcaggcaccgcgggttatcaagacggcagccaacgagacggatcatgtcatgttggttgatcacaacgaatttcaacaaagtgtcagtgatatcgaagacgtgacgattgattctgttgtcgaccatcatcgcatcgctaacttccacacggcagcgccgctgttttaccgagcagaaccggttggcagcaccaataccgtcatttttgagatgttccaagaatatggcttcaagatttcgccaacattggctggtttgatggcttctggtttgatttcagacacgctgttgttgaagtcgccgactgcaaccgacaaggataagaagattttgccagaaatggcgaagattgccggcattgatttgcagtcatatggtcttgccatgctgaaggcaggcactaatttggccgccaagtcagatatggacattatcgaaggcgatgctaagagtttcaccatgggcggcaagtctattcgcatcggacaggtcaataccgtcgatctgaacgacatttacgcacgtcaggacgaattgatcagtgccatgaccaaagaggcgcaggcgaaaggttacgacgatttcctgctgattgccactgacatcttggacagcaattcaactggtttcgcagtcggtgctgaccgcgataaaatcgccagtgctttcaacgaacagttcgacaaggacgcgcgtttggcattgcctggggttgtttcccgcaaaaagcaggtcgttccgccaatgcagagcacgtttgaaggttagttttcatctttaattgtacacaattgttttattgttctaaggaaagtcgcagctagctagttgcggcttttttgtttgcaaaaagtctctagccatctttttgcgaaatctgttaaatataaagctggctagcagttcgtgatgcgtgaatttgaaatttgtgtagcaattcgcgggtcgaatcaacagcaagtcgtcatgggtcattttggctggttttgaagcatgctgagagacgcattctgagacgagttcgggaattcaacttgatagttgttcgtcgcaagtgacttaacgaaaaaaactcaagcaaaaaatatccaatgattgtagaagcttttaaagacttggctgcaagcagcgattcaaaaaattaggcggcgcggctatcgggtgctgtatgaaattccgaatcaaatagtcgccaacgtaaatattgcgagaatggcacgatgccgtctcttcaagcactacttcgcataatatatattatgtaaagtagaatataaataattggctttgccacttgatctgcgaatctgggtgtcccctctttcagatggctgtcaaaaatttgtggtccggacgtactgttggtggtggcgattgcattttttaccaaggcaatcaattatgaattggatctttgcgtttacgctgagttgcatgcatttgtttgattgaaaatgtcacgctagccaaaaccagaaaaatgcatatcaattcaagcttcatgatgttgtgagattctcgtcagttagccggcttcgagttgcttgatgattttttgagttgtgtagtttgaaattgactcaacaacaattgagggtcacgtaacattcagcaaacttattttgttgaccaatggccaaaataagtttgctgaatgattgaccgaagtgaactcatttaatagccgaattcatgccagaattatgccagctaaaatttgtctgaccaacaggcgtttgctgacatctttgctcacctttggataaagctaaaactttattcaattctgcttcacatggcagagcaatggctgaaccagcaccaccgttcatttttcatcaacactagccctcgccaagtacagttgttttcgcgtatactaacattatctaaaagaaaacatacgttcgaggtgaaatctgtgtcgacacaaaattattcgaaattaattcatacaatgctacctgccctgccggattacattcaggactattatcagagccaaaaagcgatcccgatcgccgattcgacgctttatcagtatttacatttttatcaagagtttctgaactggctgattaacagtggtgtgacggccgcttcctcaccgcaaaccgtcccgctgaccgtgttagaacatttgtcgttgcgtgatgcccaggcatttatggcgtatttgcttgaacggccttccaagacgcaccacaacaagcgaatgactcgtcgcagtgttgctttgcgcttagtcgggatcaaggcgctttatcggtttttgacggaggaaagtgaaccccatgcagatggcgaaccttatttctatcggaatgtctggaacaaggtaaaacttaaaacccatactgaaactgcgagttaccgaaaccacaagctacaggaaatgctgtttgtggacggtgaagatgctaagtttttacagtggttggatcaaagttatgcgcaacaactgccagccaagccgcggcgctattttgaggcgacaaaagtgcgcaacttggccatgattgccttactgtttggctcaggggttcgagtcagcgaattggtgaatatgaatctggaagatttgaacatggatcggcatacggtccaagttgttcgcaaaggcaactttcaggatcgcgtcaattttgcagactggattgatccgtatgttcaggcttacttaacgcagcgagcggctattatcggttatcaaaagccgacttctcccctgtttgtgacagttgtcggccaaaaaatcaatcggattcgccaaaatacaatcgaagcctttttcaagcgttatacaaccgattatggtcggccatcaacaccacataaggcccggcacactttgggaaccaatatttatacggtcaccaaggatgtacagcaggttgcggatcagctcggtcagacgaccacaagtgcaacagatctgtatatcaatctcagtgataaaagcggtaaagaagccttgcgtgaggtttctgaaacggccgcaaaagcaaccgatcgcgggcatgaacaagcttaattgacgagagatggttactgaagttgatcatcgagtcttttgaaagcttatttcgccagaccagcctataatcgagtcagatcgaaacggaaaggtgggattgattgtgttagatgttaaagattcagtgaaccgattagcatggacaacggagcatcatttcctgcatattcaggcccgacatgattttatgcgggcatgggcagttcaatttgagatggcgtatacggactttcgcgtgattcagatggcgttgcaacttggcggcgaacaatatcatgatttgctaaagcggtttgcggccgcctatgaagcggtgtatgcctatgagtatgcctttgctgctggcgggttggctggttttgacgagcagtttgccgataaaatggcggactatcaaacagctgagcaaacgctgttgaagatcattgatgaaatcaaggcattgcagccggcttaattgctggcatcaacgaaaaaagcgtcgagcgacagtatttttactggcgtttcgacgcttttttagttagctgcgactggtagcttggcgacgcgagacgatgcgatagtacacgttaccggtgagcttgtacatgaggacatagatgatcgcgaagatacctagtgtgatgagtgagacagtcaggaagaactgccaattcggtaagccaaacaatatcatgatgcgttgaatgaatggcaatgcaaatccgacatgaatccctgctacgagtaatggcagataaaacagcattagtaactggctgttgatggttgcgcgcacttctcgcaagcttaagccgacgcgttgtaagattgtgtagcggcgggcatcggcatagccttcagataactgtttataatacaagatcaataaggttgccaaaatgaaggtgacgccgaaaatgatgccgaggaagagaaagctgcccatgatactcatggtctcatcgtaattcacggctttcgattgaactgaggccgattcagcgatacgactcttgaccaccgcttcatagagcttaagctgattggcatggcttccttgcaacatcacatcttgacttgtggtgatatcagcttgtgcctcagccgcgttttgatagcgtgcatttctcagatgctgcatggcgtcgatcatttgcttctcttcaggaaaggcaataaaaagattggggataaaagtcgcttgtgcatttggaaagctacctgcacgttttccgatcctgtaagtcttttgaccaatgcgaatggtcttgctaggaaaatttttggatgtatagatcaacacttcccctgacttaacgcgggcatgatgcctggtaaagcggttgtagctctcaatggtcatcaattgcaccgagcgcgcattgcccatactgaacggaccattgacattggcctgcgattcaagacgattgccatcaagtaaagccatcgtactggacggtccaacaaaagtgtgttgtgacttgatgatgacatgattcgcgctggccatccgtgccaccttgccgggtgcagtggtgtcgtttgccttgagaacatatgacaaatcaaccggcgtattcgtattgacgacttcattgataccgaagaacaacgtggctgtgctggcgagcgtaatcaaggtcatcgtcaccaaaatgacaatagatgcaaggccagcgccgttttgttgcatacgatagagtaaattagctacattgataaaatgcttgggtttgtaatagtaatttttgcggtttcgcaaccattttaagacgaagaccgatccggcggtgaacagtccataagtgccgcagatgactaagatcacggcaacaaaaaacatactcattgcttgtagtggattagttgttgtgaccgcgatatagtagccggcaattaaggcgataaggctaacaattagcgtcacccactttgtcttgggctcccgctcacctgctcgttgtgctcgcacgatttcgattggccgtttgcgaatgagccaaagttcatcaactaacagcaaaacaacgaataagccgatggtaatgatcccagcgatactgaaggcttgctggcttaacccaaagtcaagattgtggtcgactttgagcattttggcgagcgcaaggtagctgatgcgggaaaggacggtaccgagaataccaccgaacagtaaagtggttagtaacagcagcagcttctccactgccatcattttgccgagttcacctttgccaaacccgatgatgttgtaaagtcctaactgacgaatacgctgtttgcgcagaaaattgtttgcgtagatggcgagaatcacagagataatcacgatgacatctgtgccgaacatgaacagtgacttgccagcggctgcccccagctttttaaacaagacatcactactggcgtaagcattcagcatgattaggttgacggccatcaggaagctagtggttgtgacaaacggaacaaacaggcggcgatcggctttcaagttacttgcagcgagcttaaagtagaatttcattgtccatcgcctgcctttgtcagcatggcggtcatcgtctcgctgatacgggttagaaaggctggttgatcgagatccccacgataaagttgatgaaaaatttgaccgtcgcgaataaataatactcgtcggctgtgactggccgccacagcactgtgcgttaccatgaggatcgtttgccggttttcggcattcacatctgtgagcagatcaagcagttctgtagaagttttagaatccaaggcgccggtgggttcatcagccaacaaaatttctggctcggtgatcatcgcgcgcgctgccgccacgcgctgttgttggccgccggaaagctcgtaaggatattttttcagcaaggcatcaatgcctagtcgtggtgcgagcttagttagccgatttctcataatttcgagaggcttcttggcaaggactaatgggagaaagatgttgtcttgaacattgaaggtgtcaagcaagtcgaaatcctgaaagatgaaaccgaggtgttctcgacgaaacttagcccgggcaccttccttgacgttgctcagatcctgtccgtttagactaatatcgccgccggttggatcgtccagcgttgcaatcagatttagcaaggtgcttttgccagaacctgattcacccataattgccacaaattcaccggcttcaacagtgaaactgatgttcgtcaaggcacgcaccggctgagccccgcgactggtataagttttttcgatattttttaatttaagtaatgttgacatgtgatcgtcccctttcatttattagcttagcggggatgatgccccatgcctacttacagtgactcgtagttgcttacaagctggtaaggtagcttactccacttgccaccgcgtttggggaaaatgaatggcaaatgtgctgccttgcccaatttctgaggtgacagttagcgtcaggccaagcttttcagcgatttgtttgctcaaaaatagccccaaaccgctagctttctgatttgcgcggccgttgtagccggaataaccttgttcaaaaatccgcggtaaatcttcggccaaaatcccgataccggtgtcggccaccatgacagcatcccctttggcataaatcttaattgaaccgtgcggggtatatttaatggcattggttagcaattgttcaaaaataaaatgcagccattgactgtcactaataacagttggcaatggccccacagtcacggtcaggtccttggcgataaacagcttcgccaagtcacgaacggtctcattgactaacggtttgagtggcagttcagttaaaacaagatcggtatttaatgttgtcaacttcagatagttcaacatgaccgcaagataccgatcgattttgctgatttcaagtcgggcatctttggcgttaacaggttcgacttgcaatagaagatctaacgcggtcagcggcgttttgatttgatgtgtccatagctgcagcgtgtcgagcgtttcttgttcttgttcgtgggcagtatctctggttgtgcgcagcttttgcgtcagcgtttggattttttgataataagccaggcttaatggatccgtgatctgcacaggatcaattggatgatcgtcttgcagttgctgccattcacggcgaaaacgccaataatcaatgctcacaatcactgccagtggcgctgtcgcaaaaaaccacatattcaggacaatctcaaaggagttggccaacaaccagcttgccaaaaaacctgttgccagtaaggtcgctagcaataaccaaattgcccaacgcgagcggcaataagcttttatcatggctttgtcccctcacttgccaaccggtaccctttacccttcactgtttcaattaattgcgccaaaccaattgaagtgactttcttgcgcagacggttcatgttcacggctaaagcattgcgatcaatgaaatcgtcgccttcccacagcttttcgatcatcgcttcccgcgacaccacctcaccgtcagcgctgaacaaaagacttagcaattttgtctcagtcggtgtcagagcaacaacctgcttagccgtttttagctgattatcggtcggcacgagcgtataggcgccgtgcgataaattggtgtcgatttgctgatattgataagtgcgccgcagcatcccttgaattttcgccagcaacaccggcaattcaatcggcttagccagaaagtcatcggctcctaagttcatcgccatgacaaggttcatatcatccccagaacttgttaaaaagatgaccggtaccttactatgtttgcgtaactcgcttagccagtgaaaaccattaaaatatggcagactgatgtccatgatgactaggtctggtgccgccgctgagatttccgcgtcaacttggtcaaacttggtgaccgtgctgacggcaaacgcccagcgatttaagtaatcactaatcgttttggcaatcaccgcgtcatcttcgacaataaaaattttctgtgccatctcgtatacatccccttgggtatcttcaacttgttttgtgagtcagaaactgccattcaaacgtgctaatagttcgtctgggctagatcataggtttttacatcactttgatttacactaaggacagtttctattctaactgatttcgggtgttgagagtgtcacataaaaatctaggttggcaagcgcaaacagcagcgtttcttctcagtcaaaatttatttgtttttggcagttcgaccgtgttctatgctgtgttgtgggatattgcgctaaaaacgtcgtcaggggcatggatgacctatgtctcgctggcgaccgcattgccagcaattttaatctcgctcacggctggcgtgttggccgatcgctataatcgtaaaatgttaattgtgctctcggcggctgttgtcaccttactgacattattagttgcgtctatctttgcttttatgacgcaagatctttggttgctgctcgtgattgctgtgattcgtagttttggcaacggtttagaaaatcccgcagcgaatgccttgttgccacaactggtccctgccaagcatctcacgcgggtaaatggttacaatcaaatcctgatggcggccatgctcgtgatgtcgccgctgttggctggttatattttaagtgaccttgggattttttggatttttgtggtagacgccttatctgccgcgttggccatcctgtttttgagtgtggtgcacgtacgaacgccgagtgccagtcatgatcgagcagccaaacgcgccgatgggattctcgctgggttgcaatatgtcaaacgaacaccgattttgctggccttcatgctatttactgggttggcgtttatcctcgttgccccttcatcacaattatcaacattgtatgttaatcgaacatttggatcagaagtttggcatttgacgtttaatgagtggttttggaccattggcgcgggacttggcggcctttatatcgcccgtcacaaacattttcgcgatcaacttggcttgattgccatcggctttgccggcagtggtcttgccttcgctgagatgggactgccgcaatcctttagcttctatttactgtttatgtttgtttccggaatcttttacccactgattcaagccggtcaaaccatttatcttcaggaaaatgtccctgctgataagttaggtcgtgtattttcgctttgggccatcctatcgacgggaatttatccattagcgatgttggtctacggaccactggcagatcaggtgtcaattggccgcatttttgtggtcactggcttgttgctcattggtgttgcttactggttctggcaccggctgcgtaagctttcgtggtaagccattctgttctttagttgccgctagcagcgctaatgggccaaaattcaaaacaagatcggtgccaaacgtcgacatttttagctatatctggcctacgacggctctgccttgccatgacgatccttaagtcctattagattatagacaagaaaaaaagaatgattttcctaaagacggccaatcattcttttttatatggtcgctgtccgtgatggcacatcctcagtcggccgattaataccggcgttgaaccttaaacccagttggcaccggttcaaagccgacttttggataaaaagtcatggcactaggcgctgataacagcatgatcgagacatttggcccctgcattgtccgtaattggagaagcaacttggtggcaatgccttgatgttgataatccttcgttacagctaattctgacacaaatgtacaataggagcgatctgacacgccgcgtaaaacgccgattaactgttcatcgtcccacgctgttaataaaacgttggcattgttgagcatgcgttgcatgcggccgcgatcctcagtcggtcggttgatgcccgatgctgttaggacatgaatgaattggtcagcggtaatggcgtgattagttgcaattttaatcatggttatccctccctgccaattcgaaacatgttatcggcttttagcaatccgatgcgttcatagaagccgatcgccgaatctgctgccttcaatgacagcgtgacccgcggcccgatataagcttgtaaggtcgtcatgagctgatgcccaagttggtggccttcataagcaggtaaaatcaaaatatcactcaagtagcagcaatattcaaaatccgtcaaacacctagcaaagccgatcaatttcgccccatcccacatactcagaacaagtggggtttcggcaatcattgtctgcaagcggtcaggatcatcaattggcttgttaaattgcgtttgttgatacaaatcatggacttgctgaacacttaatggtgcattgattttaatggtataggacaatcaacccaactcctttttcttgaaaagtcgtctttttgcggtgtgtcgcaaactgaaaagtaacgtttgaatctggtagtacccaaaaaggccgagaaaaaatccggccttttggttaagcttcacgtcatctagcaaaaccacctgtgataatgagtgagtcaataagatattcaagtcgttgacggcgatcactttgaggtgcttgacggtgacagtttttatttgaaaacagtgatcttacttgctggaatccgatatagtgaatccggcgctcctttaggcttaccaacagcaatcagcaatgtcggcaagaaatggtccggatccaaatcaagtgccggaataattttttcgtgatcgaaacctgtcatggcacctgtttcatagccataggcgcgggcagccaacatgaacgacattgccgcaagactactgttttgaataataaattcgcgtaatgcttgttggttttctttaaaggtggcaacaagatttttaatcattggtttttgatgctcaatcgcccgatcagtcaataaaccagccgcttccgcccgtttgaagagatcctcctcaaatggtcccaagtcggtttcgccaccaataagtaccacagcggacgcggataaaatttccggtgcattggtgccagcaactgcggcgattttttctttggccgcattgctttgtgcgacgacaaaccgcgttggctgcatattcaaggcactgggcgcttttgtcgcataagtaatcatttgtaacaactcgcctttactaatggtgatttccggatcaaattcacgggcggtgtggcgtttaaggacaacttcatcaaaattattgttttccaacatcaaattcacctcttagattttttggacatcttcagaatacgccaaatgtgggcgctttcctagctgtttttcaaaatggtataggttttatgtggaaaatggaagcggtgacattccctgcttagtccatgattagttgtcgctaatgtcatctcgtgaccgcaacgatgcgcttaatagcagcgttgaaaaaattggtaggtcaataagcatttgatcccctggtggtgatgcacatgcttaaaagggtcggatcgggttcgttgtcgctattttttttgcttgctgaaacgcagtcatgatttgttgtacggctatattttgcgctgtggtgccaaaagtgatccgtaaccatcccggctttaagccatcacgaaccaaaaagccgtgattcaagagctgttccttcaaagcggccgcttgcttctgcggagcctgaaaaaattggaagttcgtttgactttgataatgtggcagaccagccttcgttaaaaatcgttcccagtcctctcgtgcctgccgaacctgttcacgggttgtctggacaaatgtttggtcgccaagggcagtgaaagctgctagttgggccacactgctcagattatatggcaggcggacggattgcatggtcgctgccagttgctcaggcacaacggcgaagccgactcgaaaattggctaagccgtatatttttgagaaagttctcaagacaaccagattagcaaagcgtggtaacaatttgagtgcgctggtagccggataatcatctgtaaattcaatgtaggcttcatcaatcagaaccaaaacacttggtggcacttgctgtaagaactgttttagctcagtcagtgacagcaaggtgcctgtcggattattaggattgcaaagccaaagcagtttggttttgggggtaattgcctgagccagcgcctcgagatcaaatgctccggtcgtcgcttgtaccggtacgttaacaaccttggcgccttcaatctgggcatgcaactgatattcggagaaagttggccacggctcaaccacttcatccccagcctctaaaaaagtacgggcaatgagctcaatgatttcatccaaaccattaccaaatacaagttggctttcagtgacgcccagttcagctgcgaccgctgatcgtaaacggctagcattgccatcaggatagtcacggctttgggtgaagtcccagtttttgattgctgtttgtaccttgtcactagtgccaaaaggattttcgtttgctgacattctaacaatatgcggcaatgcgcgttcttgcgccaaatctgccaagggtttttcggggatgtaaggttgtaaatgagtgacggtatgttttagcatgttggcgtcctccttaaaagcgtttgctggctcggaactagcctgttcacgctttgtctattaacgatgccctcttcaaggcattaatatttctcgatttttgaccgttcttgcagtcggctcttctttccttcgcgactagccaattcggtggcaatttgatcaaccgtgataccacgttcaaccataagaaccaggacgtgataagtgaggtcggccacttcaaggataaacgccggatcatctggatttttggcggcgacaatcacttctgtgctttcttcaccgactttttttaaaattttatcgagtcctttggtgaaaagataatccgtgtacgaaccggcaactggatttgcttgacgttctttgatgaaatcatatagagttggaatactttgctttgcttgggtcatgtaagatccttcccttccggataatgacgataaaaacagctgatgtggccggtatggcatgctgggccggccggatcaacggtgacgagcaaggtgtcggcatcgcagtcaactgcaattgttttaaccgtttgaatgttgccactggtggcgcctttatgccacaatgttttgcgactgcgcgaccagaaccaagtttcaccggttgccatcgtttttgccaaactttcttgattcatataagcgaccatcaacacttgtttggtggttgcatcctgaacgactgtggtgatcaggccattggctttttcccagtcaagtgtgatcatcgaaccgccacctttgcttgttttaaagcggttttcacttgcgggacagttaattcgccgaagtgaaaaatagatgctgccaagccagccgacaccgtggtttgcgtaaacaactggacaaagtctgctgtcgaaccggcgccgccactcgcaatgatcggaacttgaacggcggcagtgagttgttgatacagtcgtaaatcaaagccactttcagtgccatccgcatccatcgaagtgacgagtaattcgcctgctcctgcggcaactgcttgtttcgcccaagtgatcgcatcgagatcgactggcgttcggccaccgttaaccgtgacctgatagcgattttgatcagcttgccaacgtgtatcaatcgcggcaacaatcgcttggcgaccaaatttttcggcaccggctgtgagcaaacttggatcggcgactgcggctgagtttaatgagactttgtccgcacctgctcgcaacaaagcgtgcatatccgcgaccgattgaatgccaccgccaactgtcagcggcataaagacttgattggccactgcttcgaccgtttgaaccaaggtgccgcgcgcttcgttggtcgcggtaatatctaagaagaccagttcatctgcgccttgctcctgataagccttagcaatagcgacaggatcgccgacatcttttaactgcacaaaattgatgccttttttgacccgaccgtgatctacatctagacatgggataatgcgttttgtcagcatcttaaccctccatttgtttgagcattgctaattcaatagcgcctgtttgccatgctttgccgatgatggctgcttgaatgccagcggtttgcaagcggtgtaagtcagctagtgaactgatgccgccactggcgatgatcgtggcttggggcatcgcctgttgcaagtccgcaagtaactgggcattcgggccttgcatcatcccatctttggcaatatcggtcacgataaatgtggtgacgccgcgttgttgcatggcggttagaagggcgttggccgtctgctggctggtggttaaccaaccgtttgtcgccactttcccggcgcgggtatcaatgccaaccgcaattcgattagacccgaatctcgcaatagcttgttcgaccaaatcaggatcggaaacagctgccgaccctaaaataagccggtcaatgcctatcgtaagataaatttccatggcagccagtgttcgaatgccgccaccaagttcaataaaagccgaggtttgttcacgaatgcgcgtaatgaccgttcgattgatcggacgttgtgcccgtgcgccgtcaagatcaacgagatgcaaatgggcaaatccggcatctgtcagccgctgtgcctgatagagcgggtcttcagttaaactcacttggtcgtaatcaccttgcgtgaggcgaacgcttttgccattgagcaaatcaatcgcgggatagagcttcatcttcggtcatctccttgaactttttcaagccggctaggccaatcgcgccacttttttctgggtgaaactgggtcccaagtacattattgcgacgaacaatgctagtcagaggttgtccataatcagtggttgccagcgtaaattgtggcagcgttgttgcatagaaggaatggacaaaataagttgcttgatcagcaaacaccgcagcaaataaatcgggttgcgtgaggctgttggtgttccaacccatgtgcgggacggctaatcccgagtcagtcgggatggcaacgacttcgccgggaatgaggccaagaccagcagtttcgccgaactcgaagctgcgatcaaatagcaactgcatccctaaacagatacccaacaacggcttgccagtagcagcaaacgcttgaatgacaggcaccagttgtcgttgattcaaggctttcatcgcctctttaaaagcgccgacacccggcaaaatcaaaccggaagcagccatgataatcgcggggtcggctgagagttgattgttgacccccagataatcaagtgcttttttaacattgcgggtgttgcctgtatcgtaatcaacaatcacaatcattcaaatcacaccctttgttgagggaatgccttgcacttcaggattaatggcgactgcagctcgtaaactacgacccagtgctttgaataaggcctcaattttatgatgggtattgcggccatacagaacgctggcatgcaggttgaattcaccagcaaaggcaaccgcctggaagaaatcttctgtgacttccgtatcaaagccgcctaatcgctgattagttaattcggcatcaaaaacgaggtacgcgcgtccagagagatcgacaaccgcgcgcgccagactttcatccattggcacaaaagcactgccgaaacgctcaatcccggctttatcgccaagcgcctgcttaaaacattcacctaacacgatgccggtatcctcaatggtgtggtgcggatcaacatccaaatcaccttgcgcatcgacagttaagccaaatcgaccatgtttagcaaatgcatccagcatgtgatcaaaaaaaccgatgccagtagcaatttgaatgccactttgctgatcaaggttgagactgatcgtaatcgttgtttccttggtagttcgggtaatggtagctgtacgcataagttaaacctcctttgcggcagggacacgtttgatgatggcttcagcgtggccatctagtccttctgcttgtgccaaggtgacgattgcgtctgcctgacttgctagtgcttctgagctgtactgaatgaactgggtacgcttaacgaagtcatagacccccagtggtgagaaaaaccgtgctgatccggcggtaggcaaaacgtgattgggtcccgcgacataatcaccgaccggctcagcagcattttgaccaagaaaaacggatccggcattttgaatctgagctagatacgtgatcggatcaggcaactgaacttctaagtgctcgggtgcaattgtattcatcaatgaaaaggcatcgtttatggttgctacaatcgcaatgaatccttgattttcaattgctgctcgcgcgatcgattctcgaggtaaggttggcaactgaatatcgatctgttcgctgactgccgaagccagtttttcacttgaggttaccatcatcgcgcgcgcattggggtcatgttcggcttgtgataaaagatcggcagctaatcgaatcggatcggctgactcgtcggcaatgatgccgatttctgaaggaccagcgatcatatcaatagcaacgttgccaaaaacctgctttttagcttccgcaacatagcgattgcctgggcccatgattttatcaacgcgggggatgctttcggtgccataagctaaagcagcaattgcctgggcgccaccgacttgatatatagcgtctacgccagcgagattagccgctgctagtacaactggattaaggccatctggttgcggcggtgtcaccatcacaatctttttgacaccggccaatttagcggggatagcggtcatcaaaatggtggacggataagcagctgtgccgccgggaacatagaggccgactgcagccaacggggtgattttttgtccacgaatgatgccagggtttggcgtatcgacgaaaccgcgttcgatttcattttgatgataacttgtgatattggccttcgctaattgcaaagctttcaatagttttgacggcagttgtgcgggcgcggcatcgatgagcgcttggtcaacctgaaagtcattaacggtaacgtgatcgagcttattgctataagtacgcaaagctgagtcaccttctgctctgactttcgcgatgatcgcctgaacaatcgtttgtacatctgtattttgggcaacggcggtgcgccgaatgtcgacttgttgcttaagctggcttaacgtgccggttaaaattttcataacgatgcctcctgagggcgaactttttgtaaagattgaataagctgataaatctctgtgcgtttttgtttcagggccaagcgattgacaacgagatgtgtcgagacaggcgcgagttcggcgaacactttgaggtggttttcgcgtaaggtcgtgccagtttcggtgatatcaacgatggcatcggccataccagtgagtggtgctaattcgacagacccttcaattttgatgatttcaacgtcctcgccttgcttttgaaaatactgttgcgcaatgtgcgggtacttggtcgcgatgagtttacgtttcgtctgctttggatcaaagtctgcggttgaagcaagaatgaagcggcaacgaccagtgttgagatccaacatgtcaaactggcgatgcccttgctaagccagaatatccgaaccgacaatcccaatatcgacggtgccatgattgagataggtcagcacatccggggctttaaccaaaataaagtgaaaattcggatcatcggcaaaaatcaaccgtctgcttttggcttgaatggcctcacagtgaatcccggcagccgcgagtaagggtaagacttgcgtttcagttcgccccttagtgagcgcaatggtgagtgtcataggatcgcctcctttggggaaagatcaatcaggttagcatgctgttttgtcgctgcagcttgagcctctgccaaagtatcgaccagacacagtcttgcattcggggtggtggcaaccatcgctgctgcggcttgccattgcgatggcagaccatagacaaatgtgaggggctggtcaggcgcattcggcaattgatcagtcacggcatcaatgtcaaaagctaagccaaccgctggcaacaattcttgttgaaaacttgccagcaatttgtcatagcgaccgccgctaaaaagatattggtgaccgccatcaacgtaagcatggaagaagatgccggtgtaataagattgtggtggccggctggtgagatcgatcgtcacgcgcaactccggaaattgatctttgagaaaggccaccgtttgttgaagtggggctaagcgatccgtaatcacattcgacggcaataaccgtttcaattcgggaaagatcgtttcgctatcgccaaaaagccatggccactgttgaagaaatggataaagtgggtttgtagcaagcggcgcaatcaggtcttgataggtgcttagctctttagcaaagaaagcggtttgaaatgcatcagccgcggcatcattcagttgaagtgttcgtaagatttgcggaacgaactgggcatcagataactctaacgtgagatgtgtcaatcctagcgtgcgacaaatttttcctgcttcgctgagacatgcccactcggctttgagggagcgatacccaataagctcaatacctgcttgggtgatctggttataagtaccgcttagacttttcttaactcgaaaaatgtcgccgacataccaccattgcactggcggcacgatactcgtggtactaagcaatctcgcaagcggtaaagtcagatcaggccgcataaccactgattcgccagcatcatcgagcatttgataaggttgttcgccactgacagctaacggtttaaacacatctcgatattccaacaatggggttttgacccgctcgaacccggcttgaatgaattgttgactaatggtttgaatgagattctccttgcgaatggcccgcggcccgaattcgtcgcgtgtgccaataggcagatgccgatttgacatgagttagctcctttcgttgacatgaagtttggcttggtgctcgcgataacgcgctcgcagtcgcagaaacctatgcgctcctggtcgcgcctaaaaaaaatcgccctcgaaaacgaaaaaacgtttccgagggcgatttttgaccgcggtaccacctcaattttgtttagctcttgcgacctaaacctcacctgccaagtaactgtcagcaattgcgaacagcagttggcagcagtgataacgcaacggatgcgtgacagcttacttagttcagccgtcaagttcatagatgtgtgttcagctggctaatcgcgtcttttcagcaatagacgctctctgttgatcatgatcagcttacttgttctaatcacaacttcatgtttgttaatgtgattttcataatagccatcattttgccattgtcaacctttttttaattcggcgcggataatgccaccacaagttgtggcataaaaaggtgcggcagccagcatcaatgatgtttttttatgaatatttggtcaaattattattttgaaattaaacatctttttttgcataatcagtccactaattagggacctcagtatccgttttaagaaacgtcagtagtaattgtcgcatctctgcatcttgcgcaggtgttccaaaactttggcgaatccagccgggtaccatactgtcgcgaaccaagtagccatgctgttttaaaaaggcgccaagcgcttggggatcggcgacttgatacaacataaagttggtctgactggcatagtgctgaatgtggttggcctcaaaaaaagctgaccattgctgccgtgctgtcaatagttgctgtttcacggtttgagtgaaggcttgatcctgccaagctgctaatgccgccgtctgactaataccgctaatgttgtaaggcaagcgcacattctgcattttagcaattattcgctgcggcacgatgctaaacccgacgcgaaaattagctagaccgtacaattttgaaaatgtccgcatgactagtaaattgttgaattgggtaaccagtgacagcgcagacggattcggaacgtcggcgacaaaatcaatataggcttcatcaaccactactagcacatcagtaggcacccgcttcataaactgggcgatctgagaaattggtaaataagtaccggtcgggttattcggattgcataaccaaatcacttttgttttggccgtaatgtgcgcggctaaatcatcaagatcaataagtccggttgccggcgttacggcagcattcaccgttgtggcacccgcgatagctgcctgtagttgatattcaggataagtcggccacggttgaaggctttcgtccccgacttccaaaaatgtccggcaaatcaaggcaatcatttcatccaaaccactggaaaaaaggagctggtcggggtttacgtgtagtcgttcggccacggctgttcgtaatggcagtgcatctggatcaggataattgcgtccttgcgaaaacgcccaatttgcgagcgcttctttcactttgggcgatgtgccaaccggattttcattgaatgacaaacgcgtcagcttggcaagtcccgctgctttcgcgagtcgctccggtgtgctgtccgaaacatagtccggcagcttggcaacacttttgcgtaacatcacgccacctgctttcttaattgctttcgagtgtacgcgcaattgcttgaaaagtaaatatattatgcataaatattcataggataagcgtcgaatcaaagtattggcttgctgttgctgaccaagcacggagaaatctagttattttaattaagctgagtagtttttcttaagcaaataatcaggttaaaccatagcgcgaagtcatcaaaaaaaggcaacaatttccatacaaaggaaaaacgttgacctttttcacatagataatttttattgaaaatttgaagaaatcagtgccaaggcggagcaatcacaggccagatggggctcagctgtgcaaacaacacagcgaccgggctttgtcgctgatgttgttaggcgacttcgagaccgtgggtttggcgggctcgaagcgccgtcacgcgttccagctccatctggccggagattgcggagtttggcacggcaaagaaatttttgcactgagcttttcctgaattattcgaaatctaataattcacaagttctatgaggaactatggctcagccccaacctctaatcaatattttaatctttggcgataaaagccaaataataagtcacagccgataccgtttgcgccgaacggattttgccagctttgacacccgcaactaattcagaaaatgggactaatcggctagttacaaattcgtcttgatcgaagtcttgttttgttttatcagccaagtcaagatgtgccaacaccagattgacggtttcatccgtcatcccttcacttgaacggatagcggtcatccactgcaaatcgtgcgtcacgtagccggtttcctcgcgcaattcccggcttgcggctgtttgccagtcttcacccgggtccatcaaaccggctggtaagccaaagacttcactgtttaccgcaactcgatactcgcgattgactagcacgcgcccatcatcggtcatagccaacatggccattgcattggcgtggcgaatcaagtcacgctcaactgtgaggccatcaggcgttttaatatgttgcgtcacaacatcgaaaatcggcccatgataatgcggggtttcgctcagaatttttccttttgctagcggttgatcaaaaaacatataggcatctccttcaattgaaaaagccgcgcctaaacgcgacttctgattatgctttcgtaaaatccttcatccaagctaaggcgattgccttttcacctaagtgggtgccgacaactgggccaaagtaagatagttcgaatggaactgttggaaacttctgctgtaaatctgctaaccaacgattggcctcgtctggatcattagcgtggataacaaccgcgcgaaccggataatcaactcgatcaagttcttcttgaaacaaagtctcaacgcgagagtaagcctttttgatggagcgaattttttcgatcgccacgatcttgtgactttgatcgtcaaacgttaacaatggcttgatctttaacatgccaccgataaaagccgaggcattgctgagtcggccgccgcgaacaaggttttgcagatcattaacgataaaatactcacccatggttgtgcgtaagttatctaatcgagccaagatcgcctcaggatcatcaccggcttcggccatttgtgctgctgccaaaaccagccaacccatcaaaataacggtaatttgtgaatcataaacataaacctttgcgccttgaacctcatctacggcacctttcaatgtattcacaaaaccggaaattgtgctggccagatgaatactgatgatagtgtcatagccttcattagcaagattctcgtaaagcttcagcatctcgcccagcggcggctgcgtggtgctggggaacgttttggcagtctttaatttggcatagaattcttcggtggtgatatccttgccttcgtcgtaaaccgcgccgtcaagaataaccggaatcggcaccacagtgatgtgatgtttgtcaatttcggcttgcggcagataacaggtactatccgtcacgatagcaattttcatgtacagacacccactttttcaaaaatgattgtctacatcataccataaaaaacaaaaatgtagcgggtgcgcagtcccccaccacccgctttttgctatgccacccaaaaaccggtaaaatgattggtacaattggaaagcgagcggatcaacatgtcatttgacggaatctttacccatgccatggccaacgagctaaatgcaactttaagcggcggccgtgttgctaaaattcaacaaccttatgaaaatgaagttgtgatcactattcgagcgggacgaaagaatcatcccctccttctgtcagccaaccctcaatatgcgcgggttcagatcacgcatattccattcacgaaccctgatgttcccgcaacattcaccatgacgttgcggaagtattttaatgcggccaccttaactgccgtgcatcaggtgcaaaatgaccgggtgctccactttgagttctcaacccgtgacgaactcggcgacgaactcggcttgcggttgatcatcgaaatgatgggtcgccacagcaatattttccttgtcagtgaacgtactggtaaaattattgatctcattcggcatgtgtcggccgatcaaaatcgttatcgtcccctgatgccaggtgccccttacgttgaaccgcctaagcaagacaaaaccgatccttttcacgatccagaccggcgttaccacgcattagaacgcgaggtcacgcccgccttaagtcgcgcagcgctgttacaacagcattatcaaggcttagctaaagattcggctactgagcttgcgttacgactcaaccaaggcgatgcaggctgggatggtttctttgccgcactggcgacacccgtgccgaccatcacggcacaaggtaaaaaggccgttttcacggcaatcccctacctgtcattgactggtgagcaaagccaatatccgaccctcagcacgatgttggatgcttattatgaacaaaaggcggagcacgatcgcgtcttgcagcaaggtgggaacctgatccacgtcatcaagaacgtccttgataaagatcgcaaaaaacagcgtaagttgcagcggaccttagaggaaacggaaaaggccgatgattaccgaattcggggcgaagtgttgacgacttatttaagtcaggtcgaacgcggcatgaccagcatcgagctgcctaatttctatgatgataatcggccaatcaaaatcacactatccaaccaactgacgccgtctagaaatgctcagaagtacttcgctaaatatacaaaactgcgtaatgccgttgcccatgtccatcaacaaatgcaggaaaatcaggaagaaattgattatcttgaaggtatcatggcccagatcgacgtcgctagcccgaaagatttggccgatattcggctcgaactgcagcagcaaggctatttacgcaagcaaaagaccaacaaaaaaggggctaaacgccaaaaggtcgcaaaacctgatcaattttatgccagcgatggcaccaaaatttgggtgggcaagaataacttgcagaatgatcaattgaccttgcacaccgctaagaaaaccgatatctggctgcacgtgaaagatataccaggctcccatgttatcatcgatagtcatcagccaagcgagaaaacgttgctcgaagcggctaagttggccgcctatttttcgaaagcccgtgacagtgctaatgtaccggtggactggatcgaagtcaaaaagattcgtaaacccaatggcgccaagccaggttttgtggtttatgaagggcaaaagacggtcgctgtcacgcctgacgtcgagctggtcgacaagttacgcaacccgcctaccaagtaatcgtcacgttcaattgatgtcagtgtctagggggcaatcagaacgatgaaagcatcagacattccttcatccaaaaccgttcaggcgcatatattagctaacaagatcaaacatggctggaacaccactgatacaaatttcgaaatgttattggcctaccatgaaatggctgaattaacgacggcattattaaaggacgatcacgccaacatcgcggaagaattggctgatatcaccatttatctacttggcattgccgagatgacagatgttgatttagcccaagccgtccacaagaaagtcgccattaacgaccaccgcgtgtatgatgagcaaggccataaacatcttgaataacttgttctgacggcaccaaaaaagctcacgtcgcaaaacgtgagcttttttgatgctgtttaaccttggaacttaaacacaacattgctatcgaaaagcttgagcattttttcaaacaataacttacttagcaaggctgctgcaactggaatcacgatccagcaaaggacaaccagcgggatcgctaggccagcctccatggatgccagcggtccgaccaagccgacaatcccgaacccagaagattgcggcgtaccgctgatagaaagcagtgcaactggaattgccgaaatgatcgcggtgaacaagcacggtactaagataatcggatatttgaacaagttcggcatcatgagtttcatggcacctaaagcaattgccaaggtcacgccagatttgttcacggtccatgaataaacgacaagcgcaagtgctgttgctgcaacccccatcgccgctgcaccagccgaaactccgttcagttggatggctaggccaatggcaacagtcgaaattggactaatgataatcgtggcgaaggagcagcaaattaagattgccatgaaaatcggctgtaaggtcgtaaaactgttaattacatcgccaatcgctgcggtaaatgctgcaataaacggcaacagtaagaccccgatataggcgaccccgcacccaaccaagatcggcatggcaaccactgctgtggagccgaatttatctttgacccacatcagaaccaacacagcaattgaggcggtgatcatggtattaattaaatcaccggtaccggcaccgacataggctttcatggcaggattaaatttcacaacccccgaaccaacaaaggaagcaccagccgttaccatcatctgcattggattgaattcaaattgcaaagcgatcaaaccgccaataatcaacggtgtcgcaagttgaaaaatcacggcaatttgcgtcaacatgaccgcaaatgtgttggtgccgaagtatttcagaatgccggatagaacagcattggggatgaggccgataataacgcccaaggccgttcctgataaaaccttattaagaaaaacgcgtggcgtcattttctgggacttttcaggtgttttgttgtcttcaacaagcccgcctgctttccccttttgttcgtctacaagtgcatctgcagccgcatgggtcatctccttgttcgtcgaatcagccatcatgtgtcaccccttcattattttgcgtgcagcaactgttccttggcgtggactagttgggttaagaaggtacaatatggggtcggaataccgtacttcttaccgcgccgatcaatcacaccgttaatataatcgatctcagtcaagcggtgattggtaatcaggtcttgatgcatggacggataatgatggccgatcgtgtttggatcccaggttgttttgatgtagtccaccgtgtcaggcacattcaaatcaatgccttcttttgcggcaactgccgagaattctttgacgattgcgacaaccatgtcctcagcggttgaggtgctgccaaattcactcatattgcagtccagaatcgtgcataagccgttcattgtgccattgaccgttgctttcttgtagatcgtatacagaatattatcagagtattcagcatttagtccagcgtctgataacaatttcacgatcttttttgcagccgcggttgctgcttcgccgtcttcgacgttgcgcaaggcgactgaaccgctgccgaatagctttaatttgcctggtccttccattccggcggtccacatcgtattaccaataaaaatattgtcgcgtgtgacatatttttcgatgatttcttcatgaccgataccattcattaaacacagaattttagtatggtcagtgatcaccggctttaatgactgcatcataccgtctagttgcatggatttcgggaagaggatgacgagatcagccaccgcgtttggatcaattttggattgttcataggctttgatcttagcaacaacttgttcgccatcgaagttagcctgcaggccatgctcattgatagcattcacattgtcagcccagccgtcaataccgtcgacatcattgcctgcgcgactgagcatcaatgcatagcggccacccatggccccgacaccagcaattgtaattttcatgatctttttcctcctgtcatggcacatctctacagctgttttgaaaatctgtggaaattcaatgttctcaacgcaaacatgtcgtactgtgctttagtaaagatccgactcgatgttgtattgacttaagttcaatttgacatcgttcataaatcgtccggcttgcaggccgtcgagaatacggtgatccagcgacagacacagattgaccatgtcagcgatcttaatgccgtcatcggtgacgaccagtttcttgttgatgctttcgacttgcataatcgctgcctgcggataattaataatccccatggaggcaactgagccaaacgatccggtattgttcacggtgaaggtgccatctgccatatcagccgacgtcagtttcccagcgcgcgtgagttgcgctagacggttgatttctttggcaatcccggtgatggacagctggtcggcatgttttatcacgggtacataaagataatcatcggttgcaacggcaattgagatattgaaatcctgatgataaacaatattcccgtcttgccagctagtgttgatcttcggatgtttcttcaaggcttgaacgacggctttaatgaagaatgggaagtaagataaggaaatgccttcctgctgtttaaagttgtccttcatgcggttacgcagtttaaccatgttcgtcacatctgcttccactagcatccaagcatgcggaatttcggtggcactttgcaccatgtgacgagcaattgttttacgaataccatcagccgggacaatttgatcatgaattccaggttcaaagttgatcgtttcaggtgctggctttggtgcttccggtattgctgatgcgggcggtgcggttggcgcttgggtggttgcttgagccggagctgaaggctcaggcactgaggttggcgcgctggcgctaggcgtgtaattgagcacatccttgcgggtgattcggccattgttaccggtgccgatgacatcattaagatcgatgcctttttcttcagctaaagccaacacggcgggtgaaaaacgcttgccgccagcggcactaggtttgcttggcgctgccggaattggtactggtgctggtggcgatgccggttgtgcagccggtgaactggtggcggcagctggttcaggcgcacttgctgcgccttcaacttcgatgctcatgatcggtgtaccgattggaacctctttatcaaggtcaacgagataggctttaatgacgccagcaaaattcgatggaatttcggtcgtcactttatctgatacggtttcagctaagggatcgtattttttgacatgatcgcctggtttgaccagccaattaatgatggacgcttcgtgaacactctcgcctaaaccgggcagtaagatttgttcgatcgccatgctattttcccccttcatcaatatgctgcgagcgctttcatttcgttgtaaacttgttcttcgttaactaagaatgctcgttccagcccaacagcatatggcattgccggcacatcaggtcctgctaaccgtctgattggtgcatcgagatcgaaaagggcatcctcggcaatcatggctgcaacttcactcatgatggtgctttccttgttatcctcggtgattaataagactttaccggttttctttgctgctgcgactaaggtttcccgatcaagtggataaagtgagcggacatcaacgatttctgcactgacgccttcaccggccagcttctccgcagcagttaaggcatgttggagcaccgccccatatgcaatcacggtcaagtcgtcaccttcgcgaatcacattagccttgtcaattggcacggtgtaatccgtttccggcacttccgcttttagcaagcgatatagacgtttgtgttcatagaaaatcaccggatcgtcactgcgaatcgcagttttaatcatgccttttgcgtcgtatggatttgacggggtgacgacccgcaaacctggttgcccagcaaagatcttttccgttgattgtgagtgataaaagccgccgcgcacgccgccgccatatggagcgcggaaaactgccggcacggtccagtcgcctttgctgcggtaccgcatgcgggcagcttcggaattgagctggttgacagctggtaaaatataatcagcaaattggaattcggcgattggccggaagccaactagtccaaggccaacacccataccgccaatagcaatttccgttaaaggtgtgttgaaaacccgcttatcgccatacttggcagccaagcctttcgtgacgccaaagaccccgcctttgtcaccgccgacatcttccccgaaaataaggacgttttcatctttcgccatttcttcgtcaataccttgttggatcgcctctaaataagttaattcagccatggttcttcatcctcctttaaacgcgttcaccagcccagaaacctgcgtgtaagtatcttggtcgcaatggtcaaagtgcgaccatccacgtccaaggacacttgtactccggtttctacccgtggcagttcgcgctctcctattctgcgtacaactggtcggtgatcttggctggatctggatcaggcatggcttctgcctcatcggttgcttggttaatctcggtttcaagttccttttcaatgcgatcaatgtcggcttcgttcaggtacccttcgtcgattaattgttgttggaaaagtttcaccggatcattttctttgatttcggcaagttcttcggcactacggtatacccgctgatcatcgtcggaagaatgactggtgagtcgttcaaccatgatctcaatcaaggtcgggccgttgccttgacgggcatccgtcactgcttgcttgaaagccagataggtttcagcaaagtcgctgccattgactcgtatccccttaaaaccgaatgccgggccgcgatcagctaacttttcaacggcatattgttctttgtctggcaccgaaatagcgtatccattattttcaacgacgaagactactggcatcttgtgcacgcctgcgatgttcatggcttctgcacattcaccttgactaaaggagccatccccagtggtaaccacggtgacatagtcttcaccacgcatctgagcaccataggcaatccccgcggaaattggatactgggtgctgactggcgaggagtgactcacaatgttatgcgccttgctgccgtaatgacttggcatttgacgaccatgtgaagctggatcagcttctttcccaaaaccggccagcataatatcttttgtcgtcatcccccacatgagcactgcggtgagatcccggtagtaaggcagaaaataatctttgtcataatcaaacgccaacgccatagcagcttgcccgacttcagcaccttgtccggaaatgttaaacgagaatttaccaattcgggtcagttgccataaacgttcatcgacgcggcggccacgcataacggccttatagacgtcaagaatggtctcgcgactcaatcctgtcgttttcagtttccctgtcgttttcattttttgcatcagactcactcgctttcttatttgtgaatggctatcttgtgggtatctaaagttgcttcttgaatggcttccgatagtgatggatgcggatgaacggcatcaccaatctctgtagcagaggcatcgaggtacatcgcgtcactcatttcggcaatcatgtcggtggcgtgggcaccaatgatgctgacgccgataatgtcatcggttaccacatctcgcagcacttcgacaaaaccggctgtatcgcccaaaatgatcgctttagcattggcattaaagttgaaccggccaattttcacgtcgcgatcttgcggataattggatgaggtatagccgacactggcaatttctggatcggtgtacgtacaacgcggtacatcattgtaattaagcggtgcaactggtagaccggccatgtgttccaccgcgatgataccttctttcatcgccacatgcgccaactggagggtatcgatgacatcgccaatcgcataaatgtgatcttccgttgtttgataaaacgcattgtgggtgatgccctttgccgaatacttaatcgaggtattttgtagtccaatgtcttcaacatttggctggcggccaatcgcaaccatgactttgtcaacgattaagggatcggtttgttcagcgatggtcagtgccacctgcttatttttgatcgttgcctgttccactttggcgccgagttggatgtgaatgccgcggttttcgagttgtttctgtaattcacgggcaatcgattgactttcgttgatcaccaattgatccaaaaattcaacgatggtgacatccaccccaaagtcattaagcagagaagcccattcgacgccgatgacaccgcctccgatgattgcgactttcttcggtaaagccgtgagttcgagcatgccgttggaggtcaaaatcatcttttcgtcaattggcagactcggcaaagtctttggactagagccagttgcgatgatgacgtgtttaggtacgatcatcacgtcttctttgcttttgtcatcgaaggttaccgagacagttccagataccggtgagaaaatcgatgggcctaaaaccgcgccagttccgttaagaacggtgatcttatttttcttcatcaatccttgaaccccgcggtaaagctggtccacaacagttgctttacgcgcttgaatcttagcaaaatcaatgccgactttgccttcgatgatcccgccaaatgtcgcagctgattgcatcagtcgcagtgtttcaccgctatgcaacagtgacttggtggggatgcagcctttgtgcaaacaaatgccgccgacttttgccttctctactaaaacgacctgcatgcctaactgtgcggcccgaatggcggcaacataaccgccgggtccgccacccaggaccaccagatctgtgttcattgtcatctgccagttccccctttgattgttgacgcgtctgattgataaacgcggacgggttcttcatgattcaaaacgcgcatcaccccctcatagagtgcctgcatttccatttctcctggtcgcactaccaccggtgcaatccatgctaaatcatgttgcagcggggctgtcacagcagtggcataagcagcgccgccagtcaaaataatcacatcaacctgaccatttaaaacgcccgccatttcggcgatctgttttttaatctgatagatcatgccatctaagtagaacttagcggtttcgtcaccctcagcaatccgagcgacaatgtttttgatactgatatcgtttaggtacgagcgcaaaccgctttgactagccaataattttttgacttgggctagtgtcagccgctcagctaacactttggcaacaaaatcaactagtggcagtgagccagctctttcgggtgagtacggtccttcaccatcaatgccgttattgccgtcaatcatgcggccgttttcatgtgcatgaatgctgagacctccgccgatgtgcgcgacgatcacacggcttgtggcataggtcttgcccatagtagccaaaacttggcgggccatggctttttgatttaaaacatgggccgcactgtgtcgctcgattccttttaaaccactgatacgagcgagcggctgcaattcatctaccacgggtggatccaccacatatgccttgacgccatattgatcagcgacttgctgtgctagtcctgcaccgaggttacttgcatgttcgttgcgtttggctgcggttaaatcatccagcatcgcctcattgacagcatacgtaccgcccggaattggttttaacaatcctccgcgtccagcgactgccagcacttcgcttgctgaaaagtcctgatcggctaaaaattcttgaatggcttgcatccgaaaatctttttgtgcaataacggcatcaaattgacttagctcggctaaggagtggttaagtgtgcgttcggcgaccattttaccagccttaaataaggcgattttggacgaagttgagccaggattgatcacgatgacaacatcgcgttttggatgcatggtcatgaggcaccgcctttcagttgtgcaatcgcgaatgccagcgccgttagtttactatcaacggaatcactgcgcgaagttaaaactatcggcactttggcccccacaatcgtgccgcctgagcgagcatccgtgaatagcatcaacgccttatataaaacattgccaacatcaatggttgggacaattaacacatcggcatcaccttgaatcacgccttcataatgtttatgcgcaacagaagctggtgataatgccaaatctagcgagattgggccggcaatcacggcatctgagcgcgtttcaaactgttttgcgaccgcctgcgccaaaactgaggaaggcattttcggattaaagttctcggctgcactgagtagcgcaacttttggctttggcaaaccaatttgatgcgcaacgcctactgcattttcgacaatggcggtcagcctgtcttcgtcgggatcaatattcataccagcatcgctcaaaagaagcggccggtttagttgtggcagatgaataatcgcaacatgagacaaaactttctgaagccgcagttgatagtcaggacgaagcagttctttcagtaatgtatgcgtttgcacaatgccctttagtaaaatatcggccttaccttgagcgactaaaccaaccgcttgcgtcaccgcgtgcgcttcatcgcgcgcctgatgaaacgtccaagtgtctgcttggtcaacgttcgaaccgctatcaaacacaacaaattgcagtttgtccgccaaggtcgaagcgagctcactgcgagcacgagttacaagggttagtatgtctggttgcgaacccattggaatagcaactgtgatcatcctttcacctccaaagttgataaacggtatcttgccagtggccatttaaattgcgaacaactgttgtataacaattaaccagatgacgtctattttccataaaatttactcataaattaatgaaactaagtatataagctttaattgcccctatctgtagtataacagttggtatcgatacagcaagaaaacgcggcttgattttcctgaattctcatgaagctattttgatgaaacctgaattcaacgcattgtgcatataaatgcaatcaaatcattttctaataaatcagtttaaaatggattttcctgcttaattaatccaatatcagtcaaaataatttttttatttgccactatgtgaatcaacgatcatattctgaaattctcatttcctcatggcgtgcttagattgctcaccaatgtgacttggtttcgataagttgcacgtcatcggcaaggacaaaaaagcacggttacttcaaaaaatgttttgaagtaaccgtgcttggctttttcgatttgaacatgggactcaattggtgcggcttattgaaactgtgcgccccacttgaccggatcttcccgccattgatgcagtgaagcgagttgcgtactagtgatggcgccttgtgactcggctgtttggatcaaagccgtatagtttgtcaatgtgaagaacggtaagccagcatcggcaaaattagttttgaccgcggctagttgataactaaagattgcagcgacgcctaagactgtagcaccatctttttgagcggctgcaaccgcgcctaagactgatccgccagttgagagcaaatcatcgatgaccaccagcttagcatcggctggcagatgcccttcgatttgccgcccttgaccgtgatccttaggcttactgcgaatgtaaaccagcggtaggttcaacaagtttgcgaccaaagccgcatgcggaatcccagcagtagccacgccgccaatcgcggtaacatcaggatagtgagccacaatttgctgcgccaaaccagctgcaattttactgcgaacgtctgggtagccaatggtcaagcgattatcggtataaattggacttttcatgccgctggcccaagtgaacggtgcatcaggacgcaaggtgacggcctgaatacggagtaagtcgctggcaatttgtgtttctaatttagtcatgtgctgtttcccacgcttccttaattgattgataagccgccaccggatcatcagcctgcgtaatcggccggccaacaacaatcgctgaactgcctaaacgcttggctctgcccggggtcacgactcgtttttggtcgccgactgccgcaccatgcggtcgaattcccggggtgactaccagaaaatcaggtcgcgtcacacttcgaatgagtggtgtttccaaagcacttgccactacaccatcggcattacttgcctgcgcgatggctgcaagatgctgaaccgcttgactgatcggaatctcaatcgaaagctgatttgtcagcatcgtctgatctgtcgaagttagctgcgtgatcgcaagcatttttggtgctggatgaccagctgcctttgcgccagccaatagcccgcgtttggctgcgatcatcatgtctttcccgcctgctgcgtggacagtggtcatcgccacacctagtttacccaactgccaggccgctttttccacggtgttagggatgtcgtgaagttttaaatcgagaaaaatcgacaccggtcgggcttgttgaatctcggtgataatcgctgggccttcagcatagaaaagttccatgccaactttaacgaacaaatgttcttcttttggaaattggcttaaaaaatcaagagttgtggtcttatccttaaaatccagtgcgataataggcgtcattaaactgtctgtccttcctgtatggctgccaattcagctgcgatcttcggaatggctctcttttgataataattggctgaaccaactgcaagtgccgtggcgccggccgccaacatttctgctgcatcatggccagagctgatcccacccatcccaatcaacgggactcgaacggcatgagccacttgataaaccatgtggagtgccattggcagcacagccggacctgaaacgccgccagtcacattgtcgagaagcggtttgccagtggcaatatccagccgcatgccgacaaacgtattgatcagtgaaagaccatcggcccccgcttgttcgactgctttagcaatggcagtgatatcagtcacattcggtgtcagcttaacgaaaatcggcaccgagctcgcggctttaaccgcacgcgtcacggccgctgcgacttctgggtctgttccaaacgccatcccgccttgcttgacattcggacaggagatgttgacttctagtgccttaacattaggagcggcactcaattttttcgccactgctgcgtattcggcaacatccaccccagcaatactagcgataatcggcaagtcaggatactgcgtggccaaccacggcagcttttcatgcagcacgacatcagaaccgggattttttagacctactgcattcaaagtactgtcagggccgtcggcaaaaatagtcccttgattgccgatgcgcggtgcgagtgtcgtcgattttgtgactaacgcccctagcaaattgagatcatactctttggcgtaaccttcgccaaagccaaacgtcccactcgcgggcattaacggatttttcatcgtgaaacccggcaattgaatggccatgtggtacctccttatgtgtaggctgctgcgactgcaagtgcgttaaagcgtgcccgtcatgctataaaaagctgaaataacagcgttaataacgcaacgagcattttgatggtgatcatacctagatagtgttgaaaaaatcactttgtatggcaaggcgctcaacttttaatcggcgatattgaaaatgcttgtaattctagaactttcaaaatggctccagctgtgtctagactggtcatcaatggcacgccatgttcgatggcagcttctctaattcggaaaccgtcacttgaaaccttcttatctgcactcatagtgttaatcactaattgaattttccgattggcaatgtcttcaagaatcgtctcctggccactatcaagtttctcaatcgttgaaactgtgataccggctttctcaaaggccttagcagtgccgcttgttgccactagttgataaccaacttcgcggaatcgttttgctagtgccgttgcttcagccttgtcagcgtctttaaccgtgatcaatgcccggccaaattgtggcaagtgcatgccagccgcttcaaaagctttgtacaacgccttcgcaagggtggtgtcgctgcccatgacttcaccggtcgatttcatttccggcccaagcagactatcaacgtgattcaacttcgaaaaactaaacaccggtgatttgacgtgaatacctggctgattcggcaacaagcctgtttcaaaaccttgttccttcaaacttaaaccaaggattgccaatgttgcgacttgtgccagtttgatgttggtcactttactcaaaaacggcacggttcgactggcccgcggattgacttcgatgacgtaggctttaccatcgtgaatgatgaattgaacgttcatcaagccaatgcagtttagtgtccgcgacaatttaatcgtggcatcggtgatttgatcgataatgtcttgactaaaggtctgcggcggataaacagccatcgaatcgccgctatgaatgccagcgcgttcgatatgctccatgatccctggcaaaacaacggtgtcaccatcagagatgcaatccacttcgcattccttaccgactagatagtggtcaatcagcacaggatgatcatgtgaaacggacaccgcccgatcaatataattgtcaagttcagttgcgtcgtgaacaatttccatcgcccgtccgcctaacacgtagctaggccgaaccaaaaccggataaccaatcttatcagcgaccgctaacgcaccggccttatcagtggcggtaccgccctctggttgtggtaacttaagtgatttaatcacctgatcgaacaagtcacgatcctcggcccgattaaggtcttcaactgaagtgccaagaatcttaatgccacggtttgccaacggttcagccaagttgatggcggtctgcccgccaaattggacgatgaccccttctggctgttccagatcaatgacgttgaggacatcttcaagggttaatggttcaaagtacagcttgtcagcaatcgaaaagtcagtcgacaccgtttccggattactattcatgataatcgcttcatagccggctttttgaatggccttaacactgtgcacagtggcgtaatcgaactccaccccttgaccaatccgaatcggacctgagccaatcacgagcacactcggcttgtcgcttttaacgctttcggtgctactttcataggtgctgtagtaatacggcgtgtcgctggcaaattcaccggcgcaggtatcgaccattttgtaaactggtagtatcttttgttccttgcgcatctgtcgcacttggtcagcgtgcagaccccagagtttggcaatctcttcgtcggcaaaaccgtaccgctttacttcggcgagcaaccccagatcagctttatgtgccgccagttcccgctctaattccacaatatgtttgatcttgtcgaggaagaatgggttcattttcgataactcggcgacttcttcaatggtgtagtcgcgacggaaagcttcagcgagatagaaaagtcgttcatcgttggcttgaatgatctgtttgctcagttcatcgtcgctcaacttggcaaaagctggccgttctggatgaattagtccaacttctaatgagcgcaccgcctttagcagactttcttcaagcgttcgaccaattgccatgacttcgccagtggccttcatttgggtgcctaatgtgcggtcaccgttttcaaacttatcaaacggaaagcgtggcaatttggtgacaacatagtctaaagccggttcgaattcggcccaagtttttttcgtgaccggatttttgatttcgtctaagtgcaggccaactgcaatcttggcagccattttcgcaattggataaccagtagctttggaagccagtgcactggagcgcgacacccgcggattgacttcgatgacgtagtacttgaagctgttacgatccaaggcaaattggacgttgcagccgccttcgatcttcaacgcgcgaatgattttcaaagcagcatcgcgcaacatctggacttctttatcggtcaacgtttgggttggcgcaaagaccatcgaatcgccggtgtggacaccgacaggatcaaagttttccatgttgcagacgacaattgcagaatccgctgcatcgcgcataacttcaaactcgacttctttgtagccggcaatggagcgttcaaccaacacctgcgtcacggggcttaggttgaggccgttttccgcaatttctgccaattccttttcgttgttcgcaatcccgccgccggtgccgcccatggtgaaggccggtcgaatgataaccggaaacccgattttatcggcaaattgttgtgcttcttcaatgttattagcgatggctgattctggcaccggttcatgcaacttttgcatcaggtttttgaacaattcacgatcttcggcttgatcaatggccgtcagcttagtgcccagcaattcaatgcccaattcatccaaaatgccagtattgctaagtttcatcgctaaattcaagccgatttggccgccgatggttggtaaaatcgcatcaggtaactctttacgtagaatctggctcacaaattcgactgttaagggttcaatatagacgcgatcggcaatttccgtgtcggtcatgatggttgctggattggaattgaccaaaaccacttcataaccttcttcgcgtaaagcaaggcaggcttgcgtaccagagtaatcaaattccgcggcctgaccgataataattggaccggagccgatcactaagattttatgaatatcttgacgttttggcatgattatcctttctgcgtgcgatttgagaatgcatccatcatttccatgaactcatcaaaaagatgatcggcatcgtgtgggccaggagcggcatctggatggaactggacagtaaaggccggatacaatcggtgccgcaaaccttctactgtaccgtcgttgatttccacgtgggtgatcaacaaagtatctggatcaatgctgtcaggatcaaccgcatagccgtgattttgactggtaaaatcaattcggccggtggcaatttcacgaaccggatgattgaaaccgcgatggccatacttcattttaaaagtgttggcgccattggcgagtgcgaatagttgatgccctaagcagataccgaacagcggaattttgccttccacgccacgaatcatgtccagtgcttcaggaacgtcttttggatcaccagggccattggtgagcatcaccccgtctggcgctaattcgagaattgttgaggcggtggtggtggcaggcagcacggtaacattgcactgccgtttggcaagttcgcgtaagatactatgtttgagtccgaaatcaatgacaaccacattgcggcctgtaccaggagctgggtaagcctgttgggtagaaacctgctggacttgatttttaggtaacacgagggctttcaattgatcgaatgcgtgctcatcggctgcgtcgacaatactagccttcattgccccaacttcacgaatcttcttcgttaaggcgcgggtatcaacgccactgatgccgggaatgtgtttgcgtttcagaaattcatctaaggtcatttgactgcgccaattgccggtcactcgggcaacatcgcggaccacaatcccttttgcggttggatcgatactttcataatcgtcacgattgatcccgacgttgcctatcagtggctgggtgaaggtaatgatttggccgttgtaactttgatcggtgatagtttcctgataaccactcatcccggtgttaaaaacgatttcgcccgttgtgacagtttccgcaccgaaaccgacgccagggaaaacgctgccgtcttcaagaattaaatagcgcttcatgcttgtcctcctctaaaggcgttcactagatcagaagccgatctggtgagcgctttgcttaaacccgtttgcctgatgctaatcgcgtttgttcatactttcttaagggctggctgacgcttttttaaacgtgcttgccagctagaagcccaagctggttcacgctcttgcgtaagcaatttgcccctgactgattgtgtacagtgtttgaccgttgactttatcgccaataaaaggtgaatttttgcctttggagaaccagtcggctgggtcaatgatgtaaggcgtatcgagatccataatggttaaatcggcaggtccaccgactgtgatatggccgcctggcagatcaaatttctcagccggaatcgtgctcatgcgtgcgatcagctgttttagggtgaacatctttgatttaaccagcttggtatagagcgttgaaaaggccgtttctgacccaacaatgccaaatgccgctgttttgaaggaaccggttttttcagcagccgtatgtggtgcatggtcagtcgcaatcatatcaagcgtaccgtcttgcaagccttcaagtaaggctaagtggtcggcacgtgagcgcaacggcgggttcattttaaacattgtattgtcgcccggaatgttattttcatccaatagcaggtgatgcggtgagacttcagcggtgacgtttaccccgcgttttttagcttcgcggattaggtcaacgctttgccgagtcgacacgtggcaagcatggtaatgcacgccggttgcagcggcaagttcaaggtcgcgcgctagctgactgctttcggtttgattgatgatccccggtaaattaagtttcttggcaactgggccggcattgatcaccccgccatgcatcaggctcgcatcttcaatgtgggcaacgatgggcgcatgcaacttagcagcctgttgcatagcttgatacatggtgtcggcatcctgaaccccgaccccgtcgttggaaaaacccagcgctccagcagcttgtaaggctgccatatcaacgacctgatcagaatgtaggtcatgcgtaatcggtgcaaactgcaaaaccgtgatcttcgcatcagtttgatttttctcaagcagtggttttaaggtttcgacagtgtctggtaccggtttgagattgctcatggcgacaacagttgtgaaaccgccgtgagcagccgcagcagcgccagttttgatcgtctctttagcagtgaagccgggttcgcgaaaatgcacatggacatcaattaatcccggcatgacgatggcaccagttgcatcaatcacctgttcgtgatcgcgcggcgccagcgattgaccaatcgccgagatgatgtgatcggtaatttggatgtcagccgtgtattcagtatcgctgacaatatgggcgtgtttgatgagcatgggttactcctctccaaaatgacgggcattaatgacggcctcaagcatggccatccgcatgaagaccccgttttgcatctgagtgaaaatgcgtgactgcgggccatccaccagatcactggctaactcaacatcgcggttgactggcgccggatgcatgaaaatcgcgccaggtttcattgtcttagcaagatcatcggtgatgccgtactttgcatggtaggtttcttttgagaaagcctgacggtggtcggcgttgaagcgttccaactgaacgcgcagcagcatcaagacatccacctgcttgaccaattcaggcacggtgatgaaatcaccatattgatcgaaactggaatcgtaccattgttctggaccggcaaagtgcaacgtggctccgagtttatgcagcatctgcatatcactgcgcgcaacccggctgtgactcaaatcgccaacaatcccgatactcaagccgtcaaaatgaccgaattcttcgtgaatcgtcatcagatccagcatcatctgggaaggatgctggccggcaccgtcaccagcattgacaatcgctgtcgttggccatgcacctaaaagatcgttatagtagccatcttgtgcatgtcgcatcaccgcaatgttgactccgatcgccccaatcgttttaatggtgtcttcaagggtttccccttttgaaaccgaactatgtgccggatcaaatgggatgacagtcagacctaatttgcgttcagccatctcgaaactagtgtgggtgcgcgtgctattttcaaaaaataagttagctgcgtatatcggctctggaaaatggacggtttgaccagctttaaaatcttcagcgcgattgatcaaagccatggcgcttttgtcatcaacttgttcagcggaaacaaaatcttgaaaggatgtatctgtgaaattagataaggtcatttttttctgcctcttcttcattagcggcgtgttcaggtaagacaaagttcaggaagatcccgatcacagttgccagggcgagtcctgagaattgatacccggagaactgtaggctggcattgccgatgccgatcacgagaatggttgaagcaatcatcaagttgcgcttctgatcaaagttgactttgttgtcaattaagacgcgcaggccgttggaagcgatcaccccaaacaacagaaagctgatcccgccaataactggactaggaatgctacggatcaaggcgctaagcttaccgatgaaggcaaacaagatggcgaagaacccggcaccgcccagcacatagatactatggaccttggtcatcgccaaaactccgatgttttcaccataactggtgacaggtgggccgccaaccagaccggcgataatggatgcggtaccgtcaccggctagggtgtggtttaaaccaggatctttgaagaagtcacgtttagtcagcttgttgagcaccatgatgtgccccatatgctcggtcatagtgacaaaagcaattggtgccatggagagaatcgcgccccaataaacttgcggctgataactgataaaaggaatttcaaacttaggcaggtcgaaccaagcagcctgctgaactggtgtcaaatcaacaatgccaaagagcaaagcaacaagatagccagtgataatgcctagtagaattggcaacagactaatgaattttttgagatacatattataaataatgacagaggctaaagtgatcattgcgactgcgaagtaacgtaagtcataaacgctcttggtggcgctgatggtccgcatcgttgcatcagtggcagcagtgccggcaagagataggccgataaccatcacaatcgggccaaccacaactggcggcaaagcccggtcaatccatgctgacccgctgcgcgctacgatcaaggccacaatgagatacacaaccccaaccgcgatggtgccttgagcgatggccggatagccagcacctttcatcaaggcctgcatgatcgtgataaaagaaaagcttgatcccatataagccggtattttgccgcgcgtgatcaggatatacattaacgtcccaaccccacttgaaaaaagggcaatgctaggatcgagtccaactaagatcggcacaagaactgtcgagccgaacatcgcaaacagatgttgaatagacaggccaacccattgaccgaattttggcttgtcgccgatatctaaaacggcttcgtcgttgtgaaatgccatcttagccctccatcctttcgatgctgatcccgtctttaccgtcaagctcagaaacttgaacctgaatttgttcgtccaatgaggtcggaatgtttttaccgacaaaatctggacgaattggtaattcgcgatgtccgcgatcaaccaagacagccaagctgatcttgcgaggccggccttcgtccatcaaggcatctaaagcagcgcgaatggtgcggccggtgaagatgacgtcatcgaccagaatgacatgtttgccggtgatattaaccggtaactgtgcgccttcaacatctggctgatgatcatgatcaatcttatggacgtcatcgcggtaaaactgaatgtccaattcgccaaccggaacctgtaacccttcaagttgttcgagacgcttggcgatccgatgggctaaataaatcccgcgggttttgatgccgactaaaacgagatcgttgagtcccttgttttgctcgatgatctcgtagctaatgcgtgttaatgcacgtttcatggttacctcgtctacaacttgttttgactgtgccattgatgtgccaccctttcttatatgtattgcggttttgatgctttggaagtgaacagtgatgcgggtgttacgctccgatgctggcatttcctaaacgcgctcgcagtcgcagaaacctgctcgcgctctacaaaaaaagtcgccttcaatccaatttgggatagaaggcgaccgtagcctgaataatccgccgcagcggaatggaccttctaagcctcactggacttagttaaaggtgcttgtttgattgcattaagattaccgaacgttgcgggtcttgtcaatgcctgcacgtagatcggctaaggttttttcaaaaattggcggtactggtgcttcgaagacgagcaattgaccggttgtcggatgaacgaatcccagtttagccgcgtgcaaaaattggcctttgccgggcagggtgcgttttggcccgtaaagtggatccccggccacagggtgatgaatgtatgccatgtgcacgcgaatttgatgcgtgcggccggtctctaaaatgcatttaatgaacgtgtaatgttcaaaacgctctaatacttggaaatgggtaacagcatggcgaccggctgccacgacagcttgacgtttacgatcgcggggatcacgacccaatggtgcatcaattgtgccctcatcttctttaaacgtgccacggacaagtgctaaatactcgcgaatcgacgttttagcttttaattgtgcggaaagacttagttgcgctttttcggttttagcaaccatcagtagtccgctggtgtccttgtcgatgcgatgcacgatgccgggacgaatgacaccgttgatgcccggcaaatcagtatgatataacaaaccgttgaccagtgtgccatctggatgaccaggtgcaggatgtaccaccatgccctgcggtttgtcgacgacaatgacttggtcgtcttcatacacaatatcgagcgggatcggctccggaatagcttccagcggcttggcttcaggaattgagatagcaatcacatcgccgctagcaactttgtaattggccttagttggctgcccattgaccgtcaccaagccatcttgcaaccatttttgcacctgactgcgcgtgtgagtggtttcatgcgccgtgataaccttatcgatgcgcccctgctcggtcgtgatcgtaaaggtgctagtcatcaagccaccgccttatcatgatcgaacaggataaaaattagcactaaaataaccccaaatgtgatgcacatgtctgcaaagttgaaaatggcattaaagcgccactgatccaaaaactcaaggtgaaacatgtccgtcacatattgaaaccgcaatcggtcaatgaaattaccgatggccccggcagtaatcaaggttagtcctaggcgatagatcggtttgtgcaaactgtcgcgccacagcatggcaacaaccccgaatgcgagtaaggttgtgatatagaaaaaccattgtttgccttcaaacatggagaaagctgcgccagtattgcgaatatgcgtgagatcaatcacgcctggaatcagttgttggctttcgcctaatggaatgtgagcagtaacccacgccttaatcagaaaatcaattaatacgagcgcagcggcgatgatgagataaataagcacagaagttccccctgagtaaaagcgtttgtttcctagtgtaccgcggtcaaagaaaaaccgccatcttaaaaatggcggttacgcatgagctgattaaaaaccacacaaaattagaacaggccggaaatcttgccatcgtcggtaacatccatgttcaaggctgcgggcacttttggcaagccgggcatggtaagcaccgagccagtcatgacgacaaggaagccggcgcctaacttggggatgatgtcgcgaacgtgaatcgtgaacccttccggtgcacccaacgttttggcgttatccgttaacgaatattgcgttttagccatgcagactggcaaatcctgccagccgtttttaacgatcgtgcgcaaggcactgtttgctttgccttcataatcgacatcagctccgccataaatcttttgcacaatcgtcttgattttggttttgacatcgctttgcggatcatataagcgagtaaaatgcgccggttgatcaagtgccgccaaaacagcatccgcaaccgccaatccgccgcgtccgccgtcagcccaaacggtggcggtgacggctttaacgtttagtttcgcacaagcatcaattaaaaactgaatttcggcatcggtatcactagtgaatcggttaatcgcaactacaaccggcacaccgtaactttgcatactgtggatgtggcgtttgagattgtcgaagccttgggccaaggcttcgacattttccgtttgcaggtcctttaacgcgaccccgccgttatacttcaaggcacgcacggttgcgacaatgacgactgcatcaggcgtcttgccgagcacaggtgttttgatgtccataaacttttcaccgccgagatccgcaccgaaaccggcttcggtgattgcgatgtccccgagctgcaaagccgtacgcgtggccaaaaccgagttacagccgtgcgcaatgttggcaaatggaccaccgtggatgaatgccggggtatgttctaatgtctgaaccaagttaggtttcaaggcatctcgcaatagcatcgcaatcgcaccggtgactttcaaatcggccacggtcaccggctgccggtcataagtgtatccaatgacaattcggccgatacgtgccttcagatcggcaatgttttccgccagacacaacactgccattaattcgctagcaactgtaatatcaaagccatcttcgcgcggcacaccgcttgtgggaccgcccaaaccgatcgtaacatgacgcaaagcgcgatcgttgatatctaaagcacgcttccataaaatccgccgtggatcaatattgagcgtattgccttgttgcaaatgattgtcaatcaaggcggctagggtatccaccgccgtggtaagtgcatgcatatctcctgtaaaatgcaggttgatgtcttccattggaactacttgcgcataaccgccgccagtcgcaccgcctttcatgcccattaccgggcctaaagacggttcgcgtaaagcaatcacaggatgcttaccacgttgttgcagcgcatcccctaagccaacggtgatggtcgacttaccttcgccagctggtgttgggttgatggacgttaccagcacaagtttgccaaaaggtttatcctttaaggcgttaagtgcactaaaactaagcttggctttggctttgccataaagttcaagatcatcttctgataaacctaaaccagctgcaactttcgtaatcggccacattgccgtcgcttcattggcttgtgcaatttcaatatcagacatacaacacactccttatttggcggactctttcagccctttttggatcaacgacactactttttgttttctttttttaccgaacaaaacaaaagtcacttgaccatatcgtttggttttaagaataactgtcaaatggccaaacgtaaacccctcaatttccggccaagtcatttccaaggtgttactcttaaaaagactaaccagttttaggccttgttcatggacaacaagacgatgaagcagcacttgaatgatcgcaacaagcactgtcactatggcaatgccaatggctagcagcgatggcttggtactttctaactgaacaatcgtggcaaggctgatcccgatcacgatcatactccaaaacatgctaaaatcgatccaggcaggttgataatgagttcggtattctggcactttgacacttccttaggagaaattatgcttaaactatacacagatggcgcgacaaaaggcaacccaggacccgctgggatcggcatcttggtcagtggcttgccccatcaaattcaaaaacatgctgcactgccagcaatgagtaatcatgaagccgagtttgcagccgcaatcgctggttttgaactgctgatccaagccggcttaaatacaacaccggtcgccttctacagtgattccaagcttgtgattcaggcgattgaaaagcaatacgctaagcactatcccgacctagcaggccgtttgctgaccttaatcggtcaatttcctttagtattgccaaactggctgcctgaccgggccaatcgtggcgcccatatgttagctcagcaagggttgcgccaatctgaaactaaaatataaattttcggcaaaattgcgtcatgactagaacaatcgaggcaaaaagcaatttttcttggcaaacgccactctcgtcggtactggcgccgtgatcattaagttcaacaaaagcttgtttctgagaaaagaaaaggcaaccatttccttgtaaacggaaacggttgcctttattaatggttgtgaataatatcccaaccttgtcgtctcatcacgacaattttaaattaagctgatgggtgcttatttcaaaaccttaaactgatcttttcgatccatgtaatctttatcttttgctgaaccttcaatggaaccaaatggcatttgtgcccgtaagttccagttggtcgggatatcaaaggcttcacgcactaaatcgtcaatgattggattatagtgctgcagattcgcgccgatcccattgttcgccaaggtgacccatgtgttgagctgtgcggaaccttgcgcctgttctgcccaagtcgcaaagtttgccgcatataatgggaaatcattctccaattgctttacaacgtcagtatcggtgaaatacataatggtaccgtaagctgctttaaagctggcaattttctgcttggttgcttcgtaagcctgctcagtcggcacttcactctccagccgcttcacgacaatatcccacagcttgtcatgctgctcgccaaacagaaaaaccgcgcgcgtcgtttgtgaattaaacgcagtcggcgtctcctgaatgacggtttcaatcaaatccactaagtcatccggattctgtttaacatctttgccaagtgcataaattgagcggcgttgctttaaaagattcagtaagtcttgattcacgagaaaaccacctttttataaattaaagcgtgcgctggcgcagttagaaaccggcgtgtaagcagccttggcggtgatggccaggttttggtcattgccgccaagatccttacacgcaggtttctgcgcctgcagacgcatttcagaacaagtatcattctaccaactgactaaaagtaagtaaaccccaaatatcaacattttctttcctcctacccaaatatttcgcaaatcgtcctatttgcccctccaacgtgacagcctcgcttcgcttgagtacaatgaacttattcttcttggaggtgcggtatgtcgctgattacctggcttattcttattattttggttttaaacaccttcggggcaatcttcacggttctacgcgaggtccgagatatctcaacgacttgggcgtggttgctagtgcttatttttttaccgatcgtcgggtttggtttttatttatttgctggccgcggcttatcaacgaaaaaattgcaacggattcaacacgaatatgagtctggcgtaaaagcatttgtctcactacaaaagcacgaaaacgcccggaataagttattgccaccgactgattacacgccagcggccaaggctttaactgccttttttctgaataccgcgcaagcaccggtccttgcccataaccaagtgcaactttacacggatggcgagaaaaagtttgcggcgttattccgcgatattgaggccgctaaagattatatctatgttgagtactacaccatttacaatgatgaattaggcaatcaattccagcaactgctgatcaagaaagctaaggaaggcgttgttgtaaaggtcctatatgacgcttggggttccatgggcgctacagcaaagtggtggcgccggctgaccgacgttggcgggcaagccgaaagttactttagttccaagcatcccatcactgactttcgtttgaactatcgtgatcatcgcaagatcgttgtcattgacgaccacgtcgggtatatcggcgggtttaatgttggtgaccaatacgtctcccgcaaacctaagttcggttattggcgcgacacacatttgcgcattatcggcaatacgatttacgctttaaaaattcgcttcaccatggattggaatgcaacagtcagcaaaaaagacgaaattgcttatagtgttgaacaagatagtgccgatagtgtcactgccgacagtttgacagccggtgcaacgcctatccagatcgttgcttccggacctgaccgcccaacgcaacaaattaagttgggatacaccaagttaatcaccagtgccaccaaatctgtttggattcaaagtccttatttggtgccagatgatactgtgatcgacgctttagtatccgctgccatgtcagggattgatgttcgcatcatgattcctgacatgcctgatcacccgttcattttccgcgcgacacaatactatgcgaattatttgactcgcgctggcgtgaaaatctaccattacgaacacggctttatgcatgcgaaaacggtggttgtcgataatgccatcgccagcgttggctcggcaaatttcgatattcgtagttttaagctgaattttgaaattaatgcgtttatttatgatcgtaaagtggccagtagcttgggccagattttcgaggctgatatggcgcgcagttacttactgacgcctgagctaatcgccaaacaaagcagttggcttcggtttaaacaagacttctcgcggttattatcacctattctttaagtaaaaactggcgctttattctgaatgatgtcagaataaagcgccagtttttactatataaagcttcattaacgttgccagtcgtccaagactttggtgtggccgactaagtaatgaatcgcggcatgaacaagttcgtcacgggcagcggtgagatcgtcaccttcaaggtcatatttatcacgcaaatagccggtggcaatcgcctgatattctttacgcgcctcaccatcatcttttaaataatcgtcaatcgcgttgatattatctttcgcccgtttagccaattcttcggccaaatcgtcgacatgcggctgacgtttatgcgcatagtccatgagcgtgtcattcatatccacaacggcggcttcatcggcttgcttgtctcgtttcattttgtcatctcccaataaaacaagtatgcgcctgctaatccattttttaaagctgatcgtagtgcctttgctatgtgctactagctatcaaaagtaatcaggctggtgctaggcatcaaagcaaacttgaacatttcaaaaattaattatttcagtgggctattaatttacgggaacgcgcgaataattcctgataaagttgtgaccagctttcaaaccgatcactggcaagataaaagactggtgtatctggtacaataggttcttctccaggcgcaagattttgcgccgagataacaagatcaggctgttgctcagtcgtcactagccgaatatacgcaggctgagtcaagttgagacgaacggtttcatataacggctgcggcattaaaggatcaagtgctaccttgagcttatcagcaatcgcactgtccgtcataaatggccacagcagttgatagaacccgtcaatgatctcttttgatgcattttccaatggcgcttcgcgagcgaaaaaagcctccaaggcagcttctaatcgcggataaaaagcacgcattggactcgctgttcgcgtgagatcaatataggcgccaccggggaaaatgcgctcgctgattaaaatcttcaagagattccctgccaacgctagatctgttgttactgtcggggcaatcccgacaactgttcgactgaactcgttgcggattttctcgactaactgccatgcaggtgtattacgcgctgcgtgatagccaactagagtagcggcatcaaattgttgttccgagtgaaaccgaggtacgcgccactgagttaaaaaaagatgccatgtttcatcctcagcagcctttctcggcagattatcaaacgcactcggtagtgctgcagttagtgttggccgaggtgccaattcgtcaaaatcaagggtaccaacgatggagtgattcgctaacaatcggtgtagatgaacattagctgcgaatagaagctgcgcccgcgaaaaatctgattggatcagaccagctttgtcgagttcgcgcattaattgacgcgactgcggcaaaatttccgaaaacaagggatgggcaaagtcgacaaactgccacaataattgccggtaaacttgtctaacgcgggcttccggtcccataagcgctaaaggatttaggctgatggtaacgccggctttccgcaaataaaggcgcaaagccgagattcggcggaaaaaggcggctcgtgaaaacccggtttcatccaaaagcatctgcagtgtcaattgaggccgcttcagcgtctgaatcaatagttgtcccggcaaggaccgcctatatagaaagatacgataacgatctagactgattgatggtggtgcaatcatattaccatcgccgcgtcgcagtaatggtgcagcgtctgactgcatcgtgaccaagtctgcggcaattttttccatccggcgtcggagttggcggtaactctcaccacgggttatggcggtggcagcaatatccagccggtgccccggggcctcccacaacgtgctgtagatattgatgcgatctcgctcttcccgatcgagaaataattcatcaaagaccataaagaaggcctcctcgaaagcgtttgctacagtatagcaaaggtagcaaaaaacccgataagatatgctcatagttttttaagcttttttcaaggtctcaactgatttttatcgcaaatatttttggtcgggttttttcgtcaataccgtgacgttgatacaaagttgctcttcagcttcaacaaatagttgacggttgcgactggttttcgccatacgaacttggtatactaaaagtaagcaaaagtgtcagccaataccatacacttggggtattcaaaaaaatagccccaagatatggtatttttaattgacagacaccccaatattgagtatcctaagctacataagataacgagaaaggatgatacctatgcgtaacatcacattattcacacgcaatggctgcccgcaatgccggatgaccaagcgctaccttgacacccataaaattccattcacggagcacaacatcaacgaagagccgcaatacattgattacttaaaacaaaaggggttccagcaggttcctgttctcgaagcggatgggctcgattcattctccgggttccgaccggacgccttgaagcaactggctgtttgatcagccagtttttttatcgcatcacaacgcaaccagctattataaaacgcagcgaaagcagggtttagcatgtcattaaaaacaattagtccggatcaagtcacctattatgcgctcaacaacgagatcaacattcctgtgaatgaccagattccgttgaacaaagacaaggaagcgttgcaggcatttttgaccgaaaatgtagcgccaaatacgatgcaatttgattcgctggctgatcgactgaagtatttagttgataaccactattatgaagccgactttttgaacaagtatcagccagcttttttggaaaaactggatcaatttctttcagcgcagcattttcagttcaaatccttcatggccgcctacaaatactatgcacagtatgccttgaaaaccgatgacggtacccagtatttagaagattttaaagatcgggtttttgctaacgcacttttctttgcagacggtaacgaggacttggcagttgaccttgctgatgaaatgattcatcaacgttatcaaccggccaccccttccttcttgaatgctggccgggcccgccgtggcgaactggtttcatgttttttgttgcaaatcactgatgacatgaattcaattggccgggcgatcaattcggccttggaattatcccgaattggtggcggcgttggcctcaccttgtccaacctacgtgaagccggtgccccgattaagggcattgaaggtgccgctagcggcgtcttgccagtcatgaagctgttggaagactctttttcctatagcaaccaattgggccagcgacaaggtgccggtgttgtgtatctgaacgttttccatcctgacatcatcagtttcttaggtgccaagaaggaaaacgcggacgaaaagtaccgggttaaaacactcagtcttggcgttgtcgttccggataagtattatgacctcattaaggctaatgccgatatgtacctcttctccccttactcggttgaacgggtttacgggaagccgttctcttatgttgatatcaccaaggaatatgacaacatggttgccaatccggccattaagaagtgcaagattaaggctcgtgatctagaaaacgaaatctccaaacttcagcaggaatctggttatccttatattatcaacattgatacggcaaatcgcgccaacccaatcgaaggcaaaatcatcatgagtaatctgtgctcggaaatcatgcaggttcaggtgccttccaagttgaacaataaacaggaatatgaagtgctgggtactgatgtatcttgcaacttaggtagcacgaatattcccaacctgatgcatagccgcgactttggccgcagtgtcgaagcaatggttcgtgctttgacttatgtcacggaccacagcaacatcgacgttgtaccttccgtccagcacggtaatcaccaggctcacagcattggccttggtgcgatgggcttgcacacttattttgcgaagaatcatatgttctacggttcgcctgaaagcttggacttcaccaatatttacttccttttgctgaattactacaccttgaaggcatccaataaaattgcccaagaacgcggcgaaagcttccacaacttcgaaaacagcaagtatgcggacggtagctacttcgataagtacaccgagcaagtatgggcaccgaagtatgacaaggttcgcgcgctgtttgatggcattcacattccgacgcaggctgattgggaagcgctgaagatcagtgtcatgaaggatggtctctaccatcagaaccgtatggctgttgcgccaaatgggtcgatcagttacatcaacgacaccagtgcatcattacagccgatcgttaaccgcattgaagatcggcaagaaaagaagatcggcacgatttactaccctgctccagacctttctaatgacacgatgccttactatcaaagtgcctatgatattgatatgcgtaaagtgattgacgtttacgctgctgctcagcagcatgtcgatcaagggatggccatgacgttgttcatgcgcagtaccattccggctggcctttatccttggaaagatggccgaaccgataaaatgaccacccgtgatttaaatattttgcgtaattacgcacatcataagggcatcaagtcgatttactacatccggacttacacggatgatcaagaagaaatcggcagcaacgcttgtgaaagctgctcaatctgataatcttttaacagggggagtttcccctgtttttacataagggagcgtaaacatggcaaaacagtacattgcgatcaattggaacgcgatcgaagacgaagttgataaagcaacttgggaaaaattgacggaacaattttggttagacacccggattccgctgtccaacgacttggacgactggcgatctctcaatcatgacgagcaatgggttgtcggccacgtgttcggtggcttgaccttgttggataccctgcagagtcaggacggcatggcaagtttgcggcaaaatattcgcacccagcaagaaacggctgtgttgaacaacattcagtttatggaaagtgtgcatgcaaagagttactcttcgattttttcaacgctaaacacaccagcggaaatcgatgagatcttcgattggaccaatcataacgagcatctgcaatacaaagccaacaaaattaatgatatttatcataacggttcagcgttgcagaaaaagattgccagtgttttcttggaaaccttcttgttttattcaggtttctttaccccgttgtattacttgggcaacaataagctgactaacgtggcagaaatcattaagctgattattcgtgatgaaagtgttcatggcacttatatcggctataaattccagctcggattcaacgagttaccggaagctgaacaacaaacattgaaggattggatgtacgacttgttgttcgatttgtatgaaaacgaggaaaagtacactaacgatctttacgcgaagaccaactggacggatgaagttttgactttcttgcgttataacgccaacaaagccttgatgaatttaggtcaggaaacggcttttcctgacacggctgatgacgtcaacccaatcgtaatgaatgggatttcaacgtctaccgccaaccatgacttcttctcacaagttggtaatggttaccggctgggtcaagttgaagcgatgcaagatgatgattatcagttctcaactgaagatgaagaccacgacaaataaagccgtcgcggcaacaaaaaaagccactgcaatgctttgcggtggcttttttgttttggtctgattaggacgatgatcattcactgtctttaatggtttgcttcatcatactaagaaaacgttgcgcgattctggacaactcgcgatcacgtttccagacaagcgctactgggtccgctaatgctggtgctaatggtcggaaggtcaatgatgtgttaggactttgggtggccaaatattcaagacacaaggctcgtcctaagccgacagcagtcatcccaagcgcatcgacggtcaggtcataagtcccaacaatgtaagccggatccatgccttggcctaaccagtgttcaaatgtgttgcgtgcgtgcgtggcccgcggcaggattaattcactgtcgccaatgtccgttggtgtcatcaataaattatcagttaaaggatcatcactggtcatcaaaataccccaagcatcacgaactggcagtagcaaactttcatactgcgtctgctgcttgccaggtcgcagtatgaaatcatacatgccggcctcaagattggccaccagcccttcatcggagccataggtaacatgaacatgcaaaccggggtattgatggcgcaattcttgggcaacatgaagaaccaaccgtttgccgctggtttcgcctgcaccaatgtaaaggtcaccaccaagggcatgtttactttgcaaattattctttgtgcgctcggcaattgcggtgagttcacgtgcccggtttaacaaataggtaccatcttcagttagcgtcacacgtcgattaccacgaactagcaatttaacgccgagctctttttccaagtcttttaattggcgcgatagtccgggttgtgaaatgcccagcgttcgtgccgccgcggtaatactgccgtggtcagcaatttcaatgaagttgcgtaacgtctgcagttccataaactcccctacttcctatcagccttgtttatcgcaaacagcttcctataacaattataccctatccgacaacaattgtattccctttcacacagcaggacgcaactattttgtaagtcacgctcgccacggataatttatttaaatctagtcactcgcatctcttgcaaaagatcccagcctgattcaaaaaaagcaccggctgcaaatgagccgatgctaaaggattaccaaatttgaacacgtttttcgggtggcaaatacatcccatcacctggttggacatcaaaagttgtgtaccaatcatcaagattgcgtggctgaatgttcgcccgcaattcgtgtggtgcatgcacatcaaccgctagtagcattttttgccgttcgaggcgagactttgaacgccaaattcttgcccagttgatgaagaaggcatgcagatcaacgtccggttctctcttggctgtatctaaagccgcagccaagccgccagcatcagcgatgttctcagaaacaacgagtttgccattaactttaccggcttcagtttcaagaccgtcaaattcttggatcatggcttcggtgagcttgttaaagtgagcataatcagctttttgccaccagttcaccatattgccaagttcgtcaaattgagcaccgttattgtcaaaaccatgggaaatttcatgggcaatgaccgcgccgataccgcccagattttcggaagcactttgtttcagggaatagaacggcgcctgcaaaatggcggctgggaaagtgatgtcgttcttggaaggatcataactggcattgaccaagtgacctggcatattccagacggtgcgatcaacaggcttggtgagcttgtcgaagttgtactgaagctcaacaagttgcatcgcgttgatattatcgatcagtgacttatccggattaacgtgcagcaaatcgtagacgtcctcaggtttatcgggataacccattttgagcaccatcttgtcgagcttaagaatcgccttgtccttggtcggttgtgatagccaatcagagttgctgagtcgccgtttgtaagtggcaatcattttttggacaagttgtgttacatcagccttcgccttttcgccaaaataagtgcggccgtagtaaatgccaattggttcgctaaagaaagcgttggctaatcggtaggcgtgtttggtttgatccggtgctttgggcgcaccggatagcgcacggctaaaagtaccgcctaattggcgcaatggttcgcttaaaagactaacaagactgtttagccgggtgacatacaaccagtcgcgataattgctgaagttagcttcgttgaacaactgcgtaaactcatccaagaaccgcggatcattcacaacgaccgtttctggcacctgtttaaagatcttttgcaagaagtcagcaaacttgaatggcttgagtttttcaacgacctccgctgtcggcatcgggttgtaggccttagggtaatctgcccactcttcagaactcttaacatgtttcgcaatttctgcatcaaaggccaaggcgccagctaaagttgccttttgcgcagcatcgtcaagatctgtgtaagctaaaagcttagccatcatatctttgaaaatggtcatcaattgttcgccgttttgattgcccttggcgtagtatgtggtatccggcaaaatggttcgtggacccatcaaattaatcacatttttgctggtgtctttcatgtcagcatctacgtagaaattaaatggcgggtcaatcagatgctcctgaagcagttcggctgcccgttgattgtaatctgcaaggtctttaatgccagcaaccaaatgtagttgcggcaaggctggtgcaaagcccgctgcgtctcgggtcttgaaatccttggcttgtttgtacagcgtcaccgcagatgcaaaatacttgtctggcgccgtttttttggcgtcagcaatcgctgaaaaatcagccatcattttttcttcgacttcatcggcaaggtcctgaaaaccgccagtactgcttttgtcatcaggaatgactgcctgatccgtccaagccccgttaactgcccggtacagatcatcttggtagcgcacttcactagtcattaaaaagcccctttcaatatgaacagatatgtcataatcttaacgcacttctcatttgcgtgcacggttgaatcgcttttcagccatattccttttagttgagaacaatgaagaactgattaagtcaattgttcacaatcgaaatcgctttctttttaatgattaacccgctaaaatggagcatgaagtcaaatcgatggctagtcgtcaatggcagtcatcattcaggaggattgaaaatgtattatgtcattatgaagtctcatgatattcgtgagaatctggcaacagaacaatatctcatgaactcgaaacaatttgatgaaccgttactgctgttctactatgaaaagccgagtgtgattgtgggccgaaaccagaatacgcttgaagagttgaatcaaaaatacgtggaagatcataacattgttgtgacgcggcggttatccggtggcggcgcagtttatcatgatctcaataacttgtgcttctcgtttgtggttgacagtgactctgaagaatttggtgacttcaagtccttcacacagccgattgttgatgcaattcatactttaggggcgactagcgctgaagtttctggccgtaatgacatgctggtcgacggtaaaaagttctctggcagtgctatgtatacacgtaacggcaagacgttctcccatggtactttgatgctggatgttgacatgagtgtgattcctaacgtattgaatgtcccagaagacaagatcaagagtaagggcattaaatctgttaagagccgtgtgacgaacttgcggccttatctagataaaaagtatcaaaacctcactgttcctgaattccgcgatattcttttgactcggttgttcggcgttgatgacgtcgctgaaatcaaagacaaagagtatcacgtcaccccagaagacgaagtcgaaattaaaaagatttacgatgatgtttacaacaactgggattgggtatatggccatagcccggaattcaccaccaagaagcggaagcattttgactatgggacgattgatgctcgtttcgatgtcaaggaaggcaaaattgctaacgtcaaattctatggtgatttctttggtcctaaggatgttgcggatgttgccggtgcgttaaaaggcaagccttacacgtcagcagccattaaagacactttagatgccatcaacacgaatgagtacttcaccaatattcctaaggacgatgtggttaacctgctcgtaccataatcgcatcagtttttagaacttagaacctgtctagtatctgctgaatctggtagaattgtggaaaaccgactgaggagtttgtcatgccagattatccaagcaatatttctcgagcgcaatttgcgttaatacaacctgatttagaaaacttccgtaagcatacaagaccgcgtcgttatgatctttatgacgtattcaatgccatcctttactcgcttactacagggtgtcaatggcgtgaattaccgcacgatttcccggaatggcataccgtctaccgctattacgatatgtggcgagataaaccagacccgacagctgattcgctattagaaaggcttttaaaaaaactgtcgcttcctatcgctttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaatggtttaccacaagccattctcgtgacacgagctaatgtatcagatcgttcaggtgcattggctatgtttagtttggctagccaaaatttagagctggttcagcatgtcatggttgatggtggctacactggcaatgactttgcggatcaggtgaagctcattttgaatgctaagacgacggtagctaaacgcaacgagttgcatatgttcacggtgttaccgcaacgatggatcgttgaacgttcatggagttggctagacaaatgtcggcgactttggaaaaactgtgaacgtgcccttaacagcagtcttcaaatggttgtattggccttcctgaagatagttcttaaaagatactagacaggttcttaaggcagcacggccaaatgctgtgccgccttttttcatgcaaaaaggacaacctttaacaggctgtccttcgatcgatcagcgattgatcgctcaattatatttaatttgactaatggcgtacgcctgaatccttttcgctccccgacctgttgccacggtgatcacgccgcgttcattataaggtttaacagtcgcggcctcaatatcgaccacgcgtcccttgaaccgatggcgatcaatcgtattgatcgcgacctcatgctgcgtgtgcaatgcatcttgaagcaagttggtaatttcttccgggcgttgtgccataagcaattcctccttcatcctaagagcagacgagcgaaaaacctgtccgcagatgtctcaatgcgcatcgctgctagccgcggtgaacatcagtcagcgacgatgcagtgactgaaatcggttacagcttcagtataacggttgtgtcgaaaaatttcagtatccgcgcgtgagatcaacttgatggcttgccaattggccgcttgatatcaaggttttgaggttatcattaaatattttaaaaactttgtcgcgtaattgcggcaccgtgcccgaaatatgcggcgtgagcaaaacgttcgtcatgccccataatggtgagtcttgcggcagtggttccggatccaccacatccaaggcagcagcactgatttgcttgtttttcaatgcctgcgtcaaagcagccatatcaactgacggaccacggccaatgttaatgaaaagcggttgtttgctagcggctgcaaagaatgcttcatcataaaagtgctttgtatctggcgttaatggtaacgcgttgatgacgacatctgctcgccctgctgcctcatgggtcgccacatccgtcatcacttggtcaaatcctgcagctggacggccatgtgcactcacgccaattgtgtgcaagcccaatgcttggagtttggtcgcaatcgttgatccaatatgaccggtgccaaaaatgactgctgttttgcccttaagcaatgtcattggcggtcgctcttggcgtaatgtccacatgtcgcgatctgctcgaatggctggcaaaataccgcgactgatcgtaaacaaggcgccaagcacatactccgcaatgggttcggcgtgaatgccgcttgtattagccagcaagacatggtgtttagccaactcagccaatggtaaataatcaacgccagcggacatcgcctgcacaaactgaagtcggtcaaagttcacgcgggtagccgcagcattccaaccataaaccacgtcaatttgttgagccgtggcatcatcaagcttgtcagcatcgatgacggtgtgtcccgctgcttcaagtgtttggcgctgctccggcttcagactaaagctgtttagaatcttcatcatgtcgcactccttttcaaaaaacgcgtacgtaggcgcagaaacctgcgtgtaaggaccttggctccaatggccaaagttcggccatcacagccaaggccgctcacttacactccggtttctaaccgcccctggtcacgctctatcatggtgccagttaggtttgccccaatattggaaaagatcggttcggatagtcccattatacagcttgcggcgcttggttgccttgctgccataagccttttcaaagcccatgtcacttgtcaaaatgtacttgctccaagtggtcaaaggcgcaaatgcttggcccatttctgcgtataattgtcgaaccatggcctgatcgttgagccgtttcccataaggtggattggcaacaatgaccccgttttctttggtcgtcgaaaaatctttaaccgccaattgtttaaactgaatgctatgcagcaagcctgcttgttgcgcattcaacttggccatctcaatcatgtcaccgttaatatcgcttgcctgaatatctaattcacgatcaaagtcagtttgatccatcgcttcatctttgacggtttgtaagactggctggtcaaaaaagccaaagttctcaaaagtaaattggcgttgcagacccggtgcaatgttatggccaatcaaagcggcttcaatcgcaattgtgccggaaccagtggttggatcgacaaacggcatatccggatgccagtttgtcaacatgattaacgcggccgcaaagttttccttcaatggcgcctcacctttggcaattcgatacccgcgtttaaacagacttgatccagtcgtatcaagcgtcaatgttgcaatatcttttaaaatcgaaacttccagcgggtaagtcgcgccagtttccggtaaccgcgtcgtgcgatgataaaccgcagacattttttcaacaatcgcttttttggtgatggcttgaacgtccggttctgaatgtaattgcgaacgaaccgctcggccctcaaccgggaacgctgcgtcaagcggtaggtagtgatcccaaggtaacgccttaacgccttcaaaaagcgcatcaaaagtcagcgccttgaattgaccaacaacgattttaattcgatcggcactacgcaaccaaacattggttagcgcgattgtcttatcatcgccttcaaaataaaccttgccattttctgttcgggtttgaatgccaagggctttcaattctttagttgtcacagattcaagtccggcagccatcgtggcaacaagttgatatctcatatgggttttcctttcattcatgcagcgtttttagtggttagttttagtttacaagtttttgagatgatttgggggaaaatggtacttgagttggtgattagaaagtggtcgtgatgatcacaggaatttttgtgtaaggaatttgaaggtaaaaaattcgtggttcttttaaacgcgcaaacaaaagcagaaacctgcacgtaaggaccttgaccctaatgaccaacgtaaggtcattagggtcaaggccacttacattccggtttctaaacgcttttgtttccgctcttaaaaaaacagcccgggtttccccgggctgtgcctgcatgtagatccctataagccatgttttgttccagaacttgttcaggcacaagctccttcagtcatcatctatctcagcgttaccgctgtattgccgtcgcttcaatttgcttggcaaaacgcccctaccaaaagtttgggttactcgctcgcggggtttacccgttccaccgctcaggtttccctgatcgtttcgtcactgtggcacttttcagacctactagcgcatagctgacgccttagcgcgtttggccgccgtagccgtttacacggcccctaagcttattgggcttagcacgaacactacaagcatctcagcttgtgcgggcatggactttcctcagcctgcaaaagcagaccgcgatcactcaggacctacatgtgatcattaatattggtcaacgtcggaatggttgccgtcatcatgattgtcaacactgctatcagatagctttgagccgaacacatgacgttccagattactcagacgtttaagaatatcataatttgtcgcagccgcattggtttgcggcgtctgcgcactgacattcttggaaacactcagctgtttggtcagctcgtcgacccggctaaacagcttggtattttcttccttcagtcgatcaatctcattggtgaaagcttcgtaatcgcggatgataccatccaagaattcgtcaacttcatcaggatcataaccgcggaccttgtttttgaacttcttgtccaaaatatccttaggcccgtactggatgctaaactttgtctctttgttactatccattccgacacacctcattgttttcatggaaccaaactactaattagcttaccatatctcaatcattttgaaaatgctcattttcagcttctgccattgcttgcgctgtttcttctaaatcatccatggtaatgagctgaactggataatcacgacggtcagccatcgcctctgctgcttggtaatcccatttagctttacctggaaattctggatcataaaccagcagcgctgcatctgtatggatggtcatgaaccgggtatagccctgcaactgcgctggttgttgatacggtgcttgcgacaccgcatcagaaaagtccacttgtccacgtagggccgccagttgaccttggttatcttcattccactgcttgccaaaatctgtgaatggaaccatcatcgcaattttaaaatctggatacaatggtttgagtcctaaagcaacctcgactgcccactgctccacgcctaattgcccgccagtaattaaccattccaagccttcatcaagaaactgcatgagcgtattttttaatgaagttttaagtaccttaagttttgggtcattactgccaaaaacgttgagctcataggcacggtaccccgtgacccataatcgttttccagccatgacttacctccgattattaggccaaagcggctgatattggtataatagcgcaaggagtgtgatcgcatgaccattcattaccctaatggtaatccatacaaagacgggacgcaattttcatcacaagctatttcgcgtccaactatctatggtggacgcggtatgacgttggaagaagaattgaacatcagtaatcaatattaccgcagtattgataaagcggtcgtctacaagaaaccgaccccagttcagattgtgaaagttgactaccctaagcgaagtcaggctgtgattcgcgaggcctattttaaaacgccgtcaacaacagattataatggtgtttatcgtggattttaccttgactttgaagccaaggaaactaaaaataaagcgagcttcccgctaaaaaactttcatcagcatcagattgagcattttcggcgctgtttgaaacaaagcgggatctgttttgtggtcattcggtttgcaaccctgaaacgtctctttgttttccctgctggtcgactgattgactgttgggaccgacaaccagacggcggtcgcaaatcgattccattgaaggatattgtcacaaacggattcgagcttcatccacaactacagccggtcatcccctttcttgatggggttgactggttgattgaaacgaaagtaggtaatgtgcgtggctgataatcaaaatatgtcgcgaatggcccgacgccgcgaagataagttcacgaaaggatctgcccctaaaccgccaaaacgattatggcggcgaattcttaagtggacgttgctcgcgatcctggcatttttcattctcggcgttggcctgttttcttggtacgctaaagacgcgccagaagtgactcaggcaaaattagagtcaggcggttccagtaccatttatgatcgatctggcaatgaaattacgacacttggtttggaaagtcgggattatgtgaaggcctcggaaatcccgcaacaattaaaagatgccgtcgtctccattgaggaccggcgcttttatgatgagaaattaggggttgatcctgtccgaatcatcggggcagcgtttaataatataacaggcactagcgatggtttacagggcggctcgactttaacgcaacaactgatcaaattgtcggttttcagtaccaagtcctccgaccaaacccttcggcgtaaagcacaagaagcttggttggccatgcaggtccaacaaaaatatagcaaggatcagattttagagtattacattaacaaagttttcatgaactatggtcaatatggcatgagcacgggtgctaagttttactttaacaagtcactgaaggatttaacgcttgcacagactgcgtttattgcaggcctgccgcaaagcccagccggttatgatccctatgaatatccgcaaaaagcaactcaacggcgcaatgccgtcattgatgccatgttgcgtgataaaaagatcaccgcgacggcggctaaacaagccaaagcaacaccaatcactgatggcttaaagccaaaacagcagcaaactaataccgcaaccaatgacaaagtgattgattcttacctcactcaagtgattgccgaagttaagaaaaagaccggccttaatccatataccgacaacttggatatttatactaatatcgatatgggcgctcagcgtcggctttatgacattgttaacactgacgaatacgttaacttccctgatgatgccttccagaccggtgtcacgatgaccgatccaaacaatggtcaggttctcgcacaaatcggtggtcgaaaaactggcgacgtccgcctggcctataatcgtgctgcacaaaatacacgtagcaatgggtctaccatgaaaccgttgatggattatggaccagcaattgaatatctgaattactccacttacgagcagatgaccgatgaaccgtacacgtatccgggcacgagcatttcactttatgattgggacaagaagtaccaaggacgcatctctatgcggacagcacttgaacaatcacgaaatattccggcggtcaagacccttagtactgttggcatggcaaatgcggttaaattcctcagtggtttagggatcaatttgccaagttcggaacaatatctctcaagtgcgatcggtgcttctgtcaataccgttcaagaagctggtgcttatggcgcctttgccaacggcggcacgtactataaaccgtactatgttagcaaagttgtcaccgctgatggcaatacccaaaccttcaatagtcaaggcagccgggctatgaagtccagtaccgcctatatgattactgacatgttaaaaggcgttctgaccaaggggaccgggacctcggcggctatttctggactgtatcaagctggtaaaactgggacgactgactatagtgatgccgaactccaacaaaaccccgcattgaacgcaactggcattgccaaagatgcctggttcacaggttatacacgtagccgagtcatttcggtttggaccggttatgataaaccgacttcacacgggattagctatgctgaacagaccatttcacaagaaatatacaaagcactaatgacttatacgtcacagagtctgaccaatcgtgattggaccaagcctgatacagttgagtcttataatattctcaagggaagtaatccaggaacggccattaccggcggatctggtgatacgactaaagaactctacgtccgcggacacggcccaagcagccgcaaagcggcagtcgagtcctcttcctcgagctcaagcagttctgttagctcctcttcacgagaaagtattgaaagctcaagttcagtttccagctctgagccggtagtatcagcctctgcctcctctcaaccttcaaatcaagaaccaagtgccagttcaagcgaaccaagcacgccttcgggttctggtagcggcagcggtggtagtaacaacccctgataacgactaagctgcttcagtaaaccctaaaaaatagcctcatccgcttcttgcacctgcctaacgacggcaatgcaagaatcggatgaggcttatttttgtatggcaattattgttggctgagtcgcacaacatccaaatgatgctgctttagcaaggcttcgccgtatggatcgttacgataatcttgcgcataaaccacgcgcttgataccggcctgaatcaaggctttggtgcaattaagacagggaaaaaagtttacgtaaacagttgcaccatgggtactgacaccgttagccgcacactggataatcgcgttcatttcggcatgaattgtgcgaatgcaatggccgtctcgcatcaaatggccagcctcatcacagtgcggatcgccactaatggcaccattatagccagtcgcaatgatccgatgttcttgcaccagaacagccccaactgtggctcgctcacaggttgatcgttccgagaccttctccgctaactccaaaaaatactgatcccaactttcccgatgaacggttcgtttggatggcacaatgctatctgtcatgatttgccccctaaaggtaaataatgtgtttctaaaaacgcccattgcgtccctgctggcacttgcggatcacgggcgcgcaaatactcccggccaaaacgaattaggctgcgatgaagtttaatccattctgacgggggcatcaaggcttccagtcgcgcctgaatctgaaccggtgtcgcattttgcgggacgagtcccaacccctttacaattcgactaacatgcgtatccacagccacacctggaatgttgaatgcatcacttaaaacaacggtggctgttttcttgccaacgcctggcaaacggaccaagtcagccgctttgttgggaaccttacctgcatattccttaaccaaaatatcactcaaagctttcaaatgcgcagctttagtacgataaaggcctagccggctaatgatcgcagcgatcgcctcaaccggcgctgcagccatgtcagcaggcgtcggataagccgcaaaaagctttggcgtgaccgcattgacggccacatcggtcgtttgcgccgataacatgacggctacaagaatctgaaatggatcctcggcgtgcaaggttggttgcggatcaggataaagtgccatgatctgatcaaaaagttgtttggcttcagcatcggtcacaaatggtgcctcctcttgggctaatgatgggtgaattttcatataagattttcctggcgcttgtcattgcggctttgtcacagctcctgatgacgtctaatatctgcctgaacctgctgtggcgttttaagattgcggcgttcccagttcaacaaaatgcgatccatatattttagcgaataagccgagttcaatacagcctctcgtaaagctagtaaaatgacttccggtagataatgatcggttgtaagccaatcacgaatcgtctcttgctcaattggcgatagtggtcgtccgaattcaatctcaatttggttgaatacattggtttgcgcatcaacatttgcttgcgaagttgccggggttggtgtgccaccagctgaggttggcagtttagccaatattggactgagatcataatgatcacgcatccgaccatgaccatccgggacactttccaaagcaatggcttgtttttgaataagcgtctcaatggcactataaatcgcatttggggcaacgttcattcgggcagctaacactttcaaatccggtgcctgatgatggcttgcctgccactgatcaatgaacaaataagtcatgaactcggtttgggttaaccccaaggtggcgtagtgatcaaacagcaggttcgacagactgaactgccctgcctcaagataagttttgaaatccgtcatggtgcttgccctccaaaaaaagccggcgcacaggcgtccgacttttgattgtcatcatggtttcaaacggttgatcatccgtgggaatggaatcgcctcacgtaaatgatccagcttgcagacccacgtaattgcccgttcaagtccaagaccgaagcctgaatgtggcacgctcccatacttgcgcagatcgagataccattcgtattcgtctaaatcaagtccagcatgttcgatagcattcttcagtgtgtcatagtcggtttcacgttcagacccaccgataatttccccatagccttcgggtgccagcatgtcggcacaaacatattgctgatcatcttccggatctgtcagcatataaaacggtttgatcgtcttcggatagttcaaaacaaacaccggttgatcaaattgatcagacaggtaggtttcttccggtgaaccgaaatcgtcaccatacttgacgtccataccggcatcttgcaacattttaatggcctgcttatatgtgatccgcggatatggcaatttggtgtattgcttgagtacttctgggtcgcgatcaagcaagtgcagcggataggcgcaattatccaaaacggactgcacgaggtaggcaacgtagcgttcttggaccttcaaactctcttcttggtgacagaatgccatttccggttcaatcatccaaaattcggttaaatggcgccgagtcttacttttttcagctcggaaaactggaccacaggtgaagactttgccataagccattgcccctgcttcagcataaagctgacctgattgactcaagtaagcttttttgtcaaaataatcggtttcgaaaagttcggtcgtaccttctggtgcggaatcggtcaaaatcggcggatccattttgataaacccttcgttattgaagaactcgaacgttgctcggatcatttcattgcgaatttgttgaattgcaaattggcgcttagaacgcaaccatagatggcgatgatcaagcagaaattcgatgccgtgctccttcggggagattggatagtcgtgcgaatcaccaaccagttcgatgttacgaacctcgatttcatagccaaagtggctgcggctgtcttgatgaatcacacccgtaatccacatactggactcttggcgcagttctttagctaagctgaaaacctcttctgggacatcagcttttgaaacaactccttgaaaataagctgaaccgtcacgcaactgtaaaaaggcaattttccctgagctgcgtttgtcggtcaaccaagccccaattttaacttcttcgttcacatgttctttggcatcaatgatgcgaatctgttccgtcatgcgttaactccctatttctaatttaaataattacttgcccacaaattctcgaatacgtcgtgcggcctcgcgtaagctgtctagatccttgcaataactgatacgcgcatggtcgggcataccaaatgcgcggcctggcacgattgcaacgccggtttccgcaagcaacgcactgataaagtcatcgacggtaccataatgactcaactgtgccgctcgcttgatgttcgggaataaatagaaggcgccttgtggtttatctcccatgtcaaaccccggaatttcggctaataaatcataaaaaaggttgagccgttcctcaaatgcttgccgcatggtttcgacaatctgctgatcgcccgtcaatgcggccactgcagcatattcagacacagctgctggatttgaggtggtgtggctgataaaggtcgccatcgcctgcatgagtttttctggtccggcagcataaccaatccgccacccagtcatcgcatacgatttggaaacaccagagatcaaaacagtgttggccacaatgtcagggttgatgctgatcattgccgtgaaggttgtgccgttgtaaattaaatcgcggtaaatatcgtcggtaatgaccaagatatgatgttgcagtgcccagttaccaatcaatgtcagttctgttcgcgtgtagacaaccccgcttggattttgcggtgagttgataattaaggcacgcgttttgtccgtccgcgccgcctcaagatcatcaacactgactttgtggccttccgacggcatgaccaaatgcggcgtcccgctagcaagtttgatttgttcctcgtaagaaacccagtatggtaccggaatcaaaacttcatcgcctgggtttaagtaaacttggaacaaagcatataacgcaaactttgccccagtcgtcgccacaatctggctcgctggataacgcacaccgtcttgcgcgaaaatgcggtcgctaatggcctgcttcaattctgggatcccagtcgcggcagtatagaaactagcattaccggcttggatggcagcaatggccgcttcatcaatcgttttcggcgtctgaaaatcaggttgaccaatggacagatcaatgacatcggctccttttgccttcaaagccttggtttgattgctcaatgcaagcgtcgctgatggtgcgacgttgaggattctttttgctaaatgcacgactgcgcctcctacagttccggcagtcgtttgcgctgccgaatcatactttatttataagtttttgatcgcgttcagctgttcgccactgcgaaaactgtacgtcacgtagtttagtttaccagactttgacagatagccaatatcccaaacgaattctgacccacgttttcctaatgaagcattcaagattttctttggcgaagcactttgattaatttgctgcaacgcttgctgccgagtgatgccagatttctggtttaaaatattgactttgcccgttttttcttgaatcacaacgtacacggcttgatttttcttggtattacccgcaacagtcagataacttttgtcgcggttataccaccaaaaaccgttaatcgttttcagatttgcgcggtttgtcgcgattttctcagcttgcccacgtagttgttgataaggtgagaggcttttcgcgtagacgccaatggcaccaataattaaaacaatcaatccagtaatcacaaagaacttaacccagtcaaatcgacgatgacgcatggggtgcctcctttcgaagtatggtcagatgatttttgatagctgacgagatacgtgtggtaattaaaatttctaaaaaagcacttgctggcacaaaagcctgcatatcaggctttgaaagtaatgaccaaagttttctcggccatcgagctctggcgcttacggatggcctgctcgcaacttttggctaaaacgcgttcgccagtccagaaacctgcacgtaaggacctcaagcctaaatggccaaagcccagccatttaggcttgaggccgcttatgctccggtttctaaacgcgcctgctcacgctctgtctagccacatcttaatgtaccccggcatgtcagttagtggcaacgtcattggcttaatatttggtaaggatttctgcatttttcgaccgtagcgtgtggtgatgaatcgggggtcgaggacaacgaagataccacgatcggtttcggttcggatcaggcgcccaaaactctggcgtaatcgcaaggttgcgcgtggcaaagcatcctcagtaaatggatcgcggcctgctgcctgaagtcgttcgtatcgagctttggtgatagcggcttcgggcgcatcgaacggcaaccgggtcaagatcaccatttcgagcaaccgatccggataatcaatcccctcaaagaagcttgcggcaccgagcaataaactttgatcaccgaccgcaaaacgcttggcgatcttttccgccgaaccagtcaccccctgagccaataactctttatgatcggcaatcggtcgatgagcaaggcgttggtaaaccgcggcaatggtcgccagtgaattgaacaatacaatcgtttggtgtcggttatcagccaacaactcaatcgccgcggcaagataatcggcataggcttctgcactcaccgcaccagccgcaggagcgtccgtggcgacaagtacttttgcctgatcacgataatgaaaaggactgcgtaactttagaaaagctgtctctggtaagtcatggtaaccaagctgagcggttaaaaagtcaaacgaacggtcagtggttaaagtcgccccgacaaacaccggtgccgtaaaccgctgtagcaactgctgaatggctgatccaacctgaaagatgtcccaacttaggccaagactgctaacatcatgcatttgccgcaacgtcaaagaagccacggcagtttggccggcaaccagttctggcaagcgcgctaacagtaatttcaagcggtcacgttgatcgatcagggtgactgtcaacgcggctaaggcttgaaatcgttgaccgtcacttttcaaaaagaaatgttgccggccattgaaatctgcatctagtttagtcgcaatgacctgaatgcgaccaatgactttgatcaatgtcttaatattgtctgtttgggacgtgactaaccaattaatagcagcttgatccaagctcagactcacaaacccttgatcagccgttgtcttgccgttaaagaaatgccgatatatttggtgctgcaggatttcaatcgtttcctgggccgttgttgttagagcgttaagttgcgccaacacaggcagcatctgccgatcattttgatagacgttaaccaatgagcgatcttcatcgggatcactcaatcgccacaaatgtcgcaactgccgccgaatctgcgctaagtcgatccgttgcgcaaaggcagcggcggtattatcagcaaaatgttgcgcttcatcaacgaccagaaatggcgcctcaaggtccaacaaatcagcgtggcgtgacagaaaagcgtgattcgtaaccacgatagccgcccgatcaatggaagcacgcagccgccgataaaaatcaagtgtgtaatacgggttgataaatggtgtgcctgaatcaccagtatgccgaatttgcatgaacaatggtgcccgataagttgttaagtgcaactcatcgaggtcgcctgtggctgtttgtgtcaaccaaaccagcaatttcatttgcaataactgcgtttgccgacttggtgattcttgatgcaaactagccgcgaacttgttgagatcaatataatgttgcggacttttaacctcaactgctggcaagtctctgcctaaaacagcggctaaagtcggaatggccgtctgaattagttggctttgcaaaacaagcgttgatgtcgcaaccactaacttatgttcggcggttgcgacataagcataaggcagcaaatatccaagcgttttgccaagaccggttcctgcctcaatgaaaagtggctgggggccaccctcttgtgcatgtgcaaaaaccgcatccatcatccgcgcctgtgccttgcggaagcgatagcgcggttggagcaagtgccgtttttcaagatccgttgccggataagctgctgacgcaaacgtctcctgcgttgctgtcggcactcggcgcaagaccaacgggccaacttgaacaaacccgcgttttaacggtttcaacggtttagctattgccttcaaataatcaccggtttcccgcaataagccactgccgcgcgcaaccaacgcctgttgcgtcggactgggcaaggcctgaaagcgagccgccagctggcgcaacaacttagccgtgctaatcgcgtcactatcggcttgatgcgggttatcgtgctcaatttgtaagtaactcgttaaatcaggcaagcgaaaactgctaatctcaggcaataaaatttgcgccaattcaaccgtgtcgatcgcagctaattgcagctttggcagccccactcgctcaaattccgcatttaaaaaaggataatcgaaattaacgttgtgcgctacaaaaaccgtatcagtcaacagctgatgcaacgttttggcgatttcttcaaaataaggggccgcgactaatcgattgggatccaagccggttagtcgctgaattgccactggtaccgaccgatccggattcaccaactgagaaattgtctggataattttgccgtgctgcattaaggcacatccaaactggatcatccggtcgccgtctttgacgctggtcccagttgtttctaaatcgaccacagcaaaaatggtctcagcattcattttaaacattcccgtctaaacattcccgtctaaacatactgttcatatcatactatttaccagcacctgatgctaccagatcgacaacggttccggtgcgcaaaaagaccagatagcgatgcagcaccggtttgggttgtaaatcctgcaaagcttgtgcatataagtttaactgtccacgataacgatccactaaaacggccgtgttcgggttatgatcagttttgtagtcaaacagcgtgacgccttgttcatcactcacgtagccatcaataatcccgtgaatcaagacgtcctcgcctgggtcatcggccaatgcttcaaaaacctggtcagcaggcagcagcatggaaaatggaacttcacgatgaacctgctgcggcttagccaataacaaccgacctaaatcagtttcaaagaagcgaataagtgccgtcaaatcaatgtgctttgccacatcgaccgcaatgacctgcgtggtggccaattgatcgcgcaaagccctcaagctggccatggtgatcggcttggcgagatccactagctgcagcaatagatgcgttgccgtcccaatagctgctgggctgatgccactaggggtttcggtcagaaacgctggcgccgttaaatcccgcatcggtggcttgggaccgaggaaacgatctgcattgaccagatcaatggtatctggatcatcaaatgcgcgtttaatttctgaaacactttgaaaacctgtcgtagttgttgctgcttggaaaggataggcctttttaaaccacgcagataagtcgatcattgttcctgaatcgtcagaaactttttccggagttgcagtcggtgtgacttgcggattcacgtcaatttcaattgaaaactccgtttcatcaccgacgagcgcaggtttgatagttgtttcggctaacccacgggcctgcggatgtctgatcaaggccggtccgatccagtcgagatagctcgttgccccactgcggacttgcggggccaaaacacgcgcttcaccttccgccgccgcagcccatttttcgaccgttttatcagcagacgtcagctgattgccactcatcgttgcgccaaccacgtaaagtcgctgttgcgcacgcgtcaaagcaacatacaacaaccgcatctcttcagccaaggtctgattttgccgtgcagctttggcagcttgatactggggtaattcatattcaacgcgagtttcaggatctagccatttaataccgataccttgttttgtcaaaatggcagtgccggtttgatcgcgcatattaaaatgtttgtttgcctgcatcaaaaagacaaccgggaattccaaacccttgcttttgtgaatggtcatcaacttcaccgcatcattatctggatcgacttgggcaggcattgccaaatcttgatcctgcttctgcatcaaagtaataaagtgaataaaggcaaataaccctttgaagccacccgcttcataagtgcgggctcgatcaatcaacgcttggagatttgcctggcgctgactgccccctggggtgccgccaacatagtcaagaaatccggtatcctgatagatagcccacaacaaagtgaccaagtcattttctcgggccaagtcgcgaaaatggctgagctggttgaagaagtgcgtcagcatgtcatgcgtccgctgagcaagtggcgtttttggttcggcttgtagaaatgctgtcacggcatcataatatggcacctgttttgccgctaaacgaatcagtgccaactgatcagctgacaaaccaacaatcggcgaacgcaacacagccactaacggaatatcttgtttttggttatcaatcacttttaaaagcgccagcataaccatcaattcagttgttttgaaaaaattcttggtatcggccacaaacaatgggacgcctgctgcagcaaactgtgtttgaatcagactgttttgactggtttgacgtgtcagtaatgtgatatcgcgatagtggatgcgccgatactcctgcgcctgacgatcccatagttgcacatcgggatcgttgattaatcgctgaatttcggccaagactagttgcgtttggccagtcgcaatgtccactggctcgttatcatcagcatctcccggtaactcacttgcatcagaagaatcttcatcagatgttgctttgctatacaacaacactttcactgccggatgcgcatcaccgtaatcaagcgcaccatactttaaagccgctgcgttgtcatagctcaaatcgccaacttccggatccatgatttgactgaaaatcagattggtaaacgccaacacatttttggtcgaacgaaaattctcagctaaaataatccgttctggcgcggcgggatcggtcggtgcatcttgaaatgtttggtatttatgaataaatagttgcggatcggccagtcggaagccgtaaatactctgtttgacatccccgaccatgaatcgatcacctggcgtggtggtgctgacagcggcaagtaaagcctcctgcaacggactaatgtcctgatactcatccaccatcacttcatcgaaactcgcgcgatagttatcggcaattggtgcaccggtttgtggatctttttgttgcaaaatgcgtaaagcattatgcgcaatatcactatagtcttgaacatgccgagcggccttttcagcggtcaacgcgccttcaaactttaaggccacattagctaatgtggctactaaaggttgagcttcccgcaacaaatcgccaatttgctcagcagctaaggcaaaagttggtgccagtttgttctgccaagttttctttgcagcatcacgtagatcttttgccgcgtttttagtgtccttatctgcgtcatccagtcctttactgatgcgcgaccaagcagcaaattcatgggaaatcaagacactgcggactgtatcgtatgtgggtgcatttgtttctaatagtgtttgcaatggggcaagatcagcctgaatttgctgataccaaattgggtttggcagttgattggctaacgctgacgcctgagtcaaactggtggctatttgcagcaattggcctttaactcgcggccagatttgttggctaaaggtcgcttcccatttttccggtgcatacggcgttgccaatccttccaaataggccttgggatcagttgtcgcaccggcttggcggatcaactcaaacatcaagtcttgcaaaccgctatcatctcgatccccgctaaaattagccgtgagttgttcaaacgcaggtgcttcgtcactggcatataattgttcacgcaaatcgtcccaaacgcgctcttgcagcatgtagcgttcagtttcatccgtaagcaaccgaaaaccgggatcaagatcaatgacatagtagtaagtttggacaatttgcaaactaaaggcatccagcgtactgattttagccgcattaaccatggcaatttgattggcaagatgacgccgatcctcaccactaagctcatgtcgtcgctcggtgagtgccttcttcaaagccgtctgaatcttggttcgcatttcggctgttgccgcacgagtaaatgtcacgatcaacatccgggtaatgtcagcatgctgtttgagaatcttttgaataattcgctcaaccaacacggtggttttcccgctaccagcagaggcggaaaccagcacgtcatgcccgtcgtgggtaatcgctgcttgttgagaggttgtaaattgggtcatgcttgcgaatcctcctgacgatgatgcggaatttgtgtgggatcagttgtgacgcggccaagcacctctttgcgtttcaactttggcacatgattgtaatgatcaaacccggttgccggatcgaacagcataatactttgataatcgctgttgctgataacggtggattcctgtccatattgaaacggcgccaaagcgatatccccggctaaaatccgactggcagcatcaataatcaatgcctgattgtgcaaaagataggcacttagatcttctggtgtcagaatgtttgactgattataattgaaggcaccgtcttttttaaaaccaagtggcaccatcatgctgcgtccaccggtttctgctgaaatggttttgtctaccgccgccaagtctgccccatctttagctaccaagaaacctagatatttaaaagcttttagtcgatcaatatcgaggtcaagatcggtactgaatttgaacttaggatcttgtaagtgaaaatacagtgctccggctggcacaaatggcggatcagctgggacatttgccattgcttcaacatacgtcaacatctgtaaggcaatgccatagtacgcgtcactgtcatcgaaccgatgttgcgtgctcttgtaatcaacaaccataaatcgctgcgcatctgattctcgatagacatctagtcggtcaattttgccgcgtacattaacgcgaccaccatgcggcagcggccaagacaagccaggtaagcccctggtatccccaattcggccaaactgcaactcagtgcgcatcggacggaacccggtccggcgttgctgctggcgcatgttcgtcagcacttgaatcaataaccgacttaagcgactcgtcaaataagccatccgatgggtactgccaagaatttcataacccgggcgcttcgtgatagccgcgactaatggcgggaccgccgccgctacatctgccgcggtgacatcggccaatgtctggccggcgtcgcgcaactgagtcagatattgatccagcaccgcatggaaaagactaccagtatcggctggcgataactcaaattcaggtcgcggctgtaaaagcaaaccatacttcaaaaagtattcaaactgattacgataatacgtctctaatcgcgataccgagacattcatgtcccgaccgtacaattggactgctaatgtcggatcaagacgtccagggtcattttgataggtcaaactgcctgctagcttctgagctaacggtgccagtgtggtttgtttgagactggccaaaacgccttgccaacttcgactcaaaggcaatttctgatgctgagcttcaccagccgcgcgaacaaaatcactgagcatggcccgcggactacccagaactgcttttagagatgtccccaacccagccggtgcccatgtagcaggcgttaattgcagtgcttgggctaattgtctaaagtacggcgaggcttgattttcactgttttcctgcgtattttgcatggggtaactaagtgtcagtttttcagaagctgccataaatccaagataattgatgaaaggatcgcctaaggttgtggtcggaccttgttcaggtaaaaaacggtcatctggaagctgagccgccaacagttgccgctcttcgctatttaagacaccactatcgttaggcacatcaggcatcgcggtgtttgttgcgccaatcacataaacgtgttttgccttggccaaacgaaccaaacccgtttcggaaataaccaccgagtccagcgtcgacggaatctgcgtgtaggtggcactagcaaagccggccgccaacagttctcgaaactgatcacgattgaagtcagcttctcccaaaatggtcgcatagtcatttaacaattggatgaaggtatcccaagcctgttcgttggcttgactgcgacttaaatcaccgtcagcgttagcggtttgtcgccacacattcagctgatcaatcacaccagtcgtttgcagccattgatataagctggccgcggcttcgcgaccagttttggcagtctgccattgacgcagcaattgcggaaccgtgtccgcaaccaaagtcttgattgcattaatctgggcagttttatctgcctcgggatcaagttgcgaatcgtcagcgttaggattgcgctgaaaatagcgccatgggtcggtctgtgtccaccgttttttgccggtaatgccagtgcgaacaagatggttatctgttgtgtctaaagcatcacgaaaagccgcgatatccatattctcaggtagtaacaactcggtatgcaaaaggcgcatgacatcctgatattgataatcgtggtcttgtatggcaaaaagactttcaatgagtacgactagcggatgatccttcattggccgttcgagatcagtaaattgagggatgttgaattcttcaaagatggccggaatcaccgctgcgtatggatccaagcgacgggctaaaatcagaaaatcgcggtaacgtgcaccttgccggacggcttgatagatttggcgggcaaccgtccgtaattcatgatatggatcagtcgccactgccaactcaacttctttgttctgtgctgtctgtgcaggcgcctgtgattgtaaattggtactcgtttgccaccaatcagcaaggtgcttcatgccttcgcttagcggacgcggtttagcaaaacgatctagccggatcggtactttcatcgttttggctttttgataaaggcggtgatacaaccggcctgcaggtaagaataaattaggtgccactggtggcgcagccggatatggcttgtccagcactaaactaacggtcacctcagcagccgtttcaatcattgtttcgaccaatccagtctctgaagctgaaaagacgttgaagtcattgagataaatgaatgtgtggctcaggtcctgattgcgcatcacctgttgcaacccacttagtaggctggcattagtggcataagggccgatttccgcttcatagtgatccagaatgatccccagatctcgcaatttagcacggtgccgatcgcctggtgttaaagcggctactgtcgtattcagatcttctgctgtgatacgaccggtcactaattcgcttaattgatccgccagttgtgtcacaaacccagtgttatgcgcttcgccagcataaatcgttagttcttctttgctttcacctagtatctttgcgaccaacatcgtgttactggcccgatcaagtcgtggctgttgataaagcgcggtgtttttcaggaaataccaggcaagtcgtgagaaagacagcacctgcactcgattttgcgcatatacaccattgacggatgctgcttgcgcccgcaaccgtttcaacaagtcgacttcggcttcaaatttgatatgattagggactaaataaaaaatttggttttgtgaatcggcttgcagattagcttgaaccattgtcgccatcgtgccagcgtggtccgtcgttgcgtctcctaaaatgaattgcagccccatgcgctacctacctccttaaacgcgctccccagcgcagcaacctgcatgtaagcaccttggctgcaatggccaaggtgcttacactcgggtttctcaccgggccagctcacgctctgtctaaacgcgttcgctgccgcagaaacctccacataaggacctcaagcctaaatggccaaaacccagccatttaggcttgaggccgcttatgctccggtttctaagcgcggctgctcacgctctgtctaaacgcgatcgctggcccagaaacctgcgtgtaaggaccttggctgcaatggccaaagcccggccatcacatccaaggccacttacactccggtttctaaccgggccagctcacgctctgttacattatgctttagtctagcatatctaagtagtgtctgacgggcgtttgcgctatcattaataaagaatattgacgaggtgtttatatggaaatcgggacgggaaaaagttatgcaaaaattattctgcttggcgaacacgcggtcgtgtatggggaaccggccattgcactgccagtgaagagtgtcggcttgtcagctcgcgtcacgcctcagccggatggcagacaaactgtgacgtcttcttttttcacaggaaatttaaatgctggtcaattgaccaattttgccggtattgccatgcttattcgacgtttattgatcttctttaacgccaagaatcaaggatttcatttaaccatcacgagtgctttgccttccgagcgcggtatgggctcatctgccgcaaccgctgtggcagttgttcgcgctttttacgatgcatttcaaacatcgctatcacacgacacattactgaactgggccgctgtctctgaaaaagctttgcatggcaatccaagcggtcttgatgctgccacggctagcgctgagcggccgcaatggttcgtccgtggtaaggcgccgcgctcgatcatgatgccacgaaacggtgtgttgctaattgccgatactggcgttgccggacaaactaaaattgcagtgggagcagtggcagatcgtttaaagcaggatcccaaaatgtaccggccgctcatcaaggatatcggtgacaccgttcgccaggcagcattggcgttggcgcaagatgatattattaccttaggccaactgttcaatcgcgatcaggccgatctgtctgcacttggcgttagcagtcctgaccttgaccgtctcattaacatggcgattgataacggtgcttatggcgctaaattaacaggctcagggatgggtggttgcatgattgctttagcagccagtgatcaagcggtagcgattaccacggcgcttaaagctgctaatgcggctaaagtgtgggaataccattttgaatcgaaatgaggctattatgacgacttatgcacgcgcgcacacaaacattgcgctgattaaatattggggaaaagccaatcgcaagttgatgctgccagccacaagcagcatttctttaactttaaatgacttttatactgacacagcagttacatttgatcctagtctgaatgatgatcgcttcatgcttaacggtgaagaacaaaacccggttgcggtcagccgctttttggatcgggttcggcacttaggaaaaattagcacgtacgctcaagtcacttccttgaatcacgtgccgactgctgccgggctggcaagttcagcctctgcttttgctgccttggccactgctgccagccgcgcggcaggtctaaacctttctccgactgaactatcaagattagcgcgccgcggatcaggttcagcaacgcgctctatctttggtggtgccgttatctggcatcgcggccatgacgacacctcttcattcgctgaaccactcgcgattcaacctagtttgccattacgaatgcttgtggtcacggtatctgctgaaaaaaaggcggtcagttcacgaaaaggcatggccaacacagtggccacaagtccctactatgatgcctgggtggcctcaaatgaaagtttaattgaaccaatgattaccgcgttggctgaagacgacttagcgctgatcggcaaattgacagaattgtccagtatgcgcatgcatgcggcgattatggccgaggaaccgccattcacctactttctgccggaaacattacgggcgtggcaattagtgcaagaacaacgggctttgggtattcccgcgtttgccacgatggatgcaggaccaaatgtcaaaattctgactactgaaccttacgtggacattttattaaccgccttgcgccctgtgttcggtgatcggattttgagcacacgccttggtccggatgccagcatcatcacaaaggagcaatttgatgacacaaagtcagcaatcgcatcgcaaggatgaacatgtttttctagctgaaaaatactttcaatctgttgctcatgcgggtttcgatcaggttcgtcttttgcatcgagctttgccggaaacaaccatggctgcggtggatctaaaacctgatctcccgtttaattggcaatggccgatttatatcaatgccatgaccggcggctcgccacaaaccggcaagttaaacgcccagctaggccagctcgcccaagctttgggggtggcgattgccagcggatcgcaatcggtggcgttgcgtgatccgcaactagtcccgacttttgcaacgctgcgtgatcatgatccaaacgggtttattttagctaatgttggcgccggtcatcatgcgactgctgccgaggcggcggtggcaatgttaaaagcgaatgcactggaaattcatctcaatgctgctcaggaagtggtcatgcctgagggcgatcgcgactttatgtggcaggctaacattaagagcatccttgcgactagccaagtccctatcgtcgtaaaagaggtcggtaatggctttattcgcgaagatcttcagtccttacaacgtctgggggttcaatttgttgacgttggcggtcgcggcggaacaaactttgccacgatcgaaaatgctcgtcgttcgggccacgattttgcttatttacaagactggggacagacaacggttgaatcattgcttgaagcgcgcggactcggtctaaccatgcttgcaactggcggcgttcgttcaccattagatgttgtgaaggcattgcggctgggcgctcatgcagtcggcatgagtggcctggtgcttcatcacttgattcagactggctatgaagcgacgctggcctattttcagaactttctgcaccaattacgccaactttacgcgttattgggcgtcaccaattggcaggagctgcaagaagccccaatcgtgctaagtgctgatttggaacattatcgtcaggctcgtggcttaccgggaatttgaccctaaaacaatccaagtcatgattgacttctggaacttttattcgaagggaataatgttgcaacacaattctcagtcggcaagtaaaaacgaacgattttcctaatatcggaaaatcgttcgtttttgccaatccatagattagttgctgagattttaaagaccgtagtgccaaggcggagcaatcgtaggccagatgaggctcagccgtgcaaacaacacagcgaccggttttcggagctgatgttgttaggcgacttcgagacagcgggcttcgcgggctcgaagcgccgtctccgctctagctacgcgtcgccaccccatctggccggagattgcgaagtttggcacggcaagggactattagcctagcaccttcctacgactatccggaatttaatgattcacaagtccgatgagcaaataatggctcagcctcgttcaccggatgtgagttatgccccgaaccgagtcttctttactaaatatcaaacacgcaacccttttggataataatttttgatggtaccattcaccaatttaccaattgcaaatggcttatgctcgaatgtcagcagaacaaaacgtttgccacttaccttgcttggcaacgtttcaccgtgccgataacgtgcataaccgtccgcatcaacctcaatcacagtttgaaaatcatccggattaagagcagctgctaaactatgacttggttcaaatcgtttcttccggaaacttccgagttccagaccggcacgcaccactttcacgtgctcaaacgggatcatcgttgttggtaaaattgaaagaaaatcgccatgccgataaaataggccgctgggctgcttggttaggcttgtcgctacaaacgcatcaacttcatccttcgccggcttggctagcggtttaagcggcaaacgggctggttgatgtgatgctggttcccctgctaacttcagcttagcaacaaaatgcccttcgccacgcaatcggtgaggaaacagtcggactgttttggccagttccggattgccatcggcccacgctggccgcccagcttccatccccggatattgcttaatcggcgtaagcgtgaacgcgttattggccaatagccaggcaatgatttgctcatcttcttcaggactaaaggtgcaagtcgagtaaatcaacgtgccgcctggtgctagcatcttcacagccgctttgagaatctgcttttgccgctcagcacattgcgcaggatagtccgcatgccaatactggattgcatccggatctttacgaaacatgccttctcctgaacaaggtgcatcaaccaaaattcgatcaaacatttgtggccacgcttttgccaacgtgtcaggatcattattcgttactaaaatctgccgagtaccccaccgttccagattgcctgacaaaacttttgaccgcggaccattgatctcattgctgaccaaaagcccagtgtcgcctaaatagcaagcaagttgggtcgatttaccgcctggcgctgcacacaaatctaatacccgttcacccggctttggggctgcaacagtaccgacaaactgcgcacttggctcctgactataaacaagtccggcaacgtgatcaatgtcgttgccggcgaccttgccataataaccccacggactccaaggaattggttcagttaatgactcgtccaatggccacggcttggctggatcacgccgaaagccactttccgcaggtgcttcaaatgtcgctaaaaaagcagctgcttcatcgcccagcaaacgagtatatttttccttaaatgcttcaggtagttgcactagctttatcctttctgtgaatcaagtaacggaggaagaaaatggcagcgatggtcaaaacgacaagaaagacccaaatattagttcgcgtggtgaagtagaaccaccagtttgcaaaaaggccaccaagaaaaagactgacgccaatatgaccaccacagctagataaaacgccgcgcaagtaacgcgcccgcatattcaaatccaaaccagctgtttgcaacggccccattaagaccaccatgagcatcgtcagcaatcctgcacccagcaataagaataagctgaacaatgccgtttgaccataagcatgccaccaagtcgaagcattactatcgctaaagtggacccgatgaatattttttgctttgaaagcggtttttaaggccttgctatgctgactggcgccgtcaacatagattttgacctgctttagtttcagcttactattggtagtttgtgcagaggcgttgagaaagataactttatttagcgggctgcctttgcgtgtgcccaccgttcccaatactgggacatattgaccattcacttgcaaataacgctgattattactgccagtatacagtttatcggcaagatcgcggccaaccaccgtcaccggcagactggaggcaaaatcgccagtcgagaaccactgaccactatcgagtggcaggctcgcaactgtgccacgctgataaacgtacacgacttgtttagcaacaaactggacctgataacctttgaaatcagttttatcgagctcgcttatcgcagtggtgatgctgcgcgaacttgtcgtgacatattcctgagccgtttccgacatgccgaggtgatcaagctgactggcatattcattttgatcatgctgtgaccatactaaaccggctaatatcgctaaaccgatccataaaagatcaatcaagaataattttttcacgtcatcctcctcaagtcctgcacaaataagccatttgccaacagtacagagactattgtaatcggtaaactcgttcgtgaatcgcatcaaaatgaccaaacgcacgattaagcgcgaataatcgccgatccggaacggttcgggcttcttgccaaaataaccggctattggttgcaccgttgcgttcgccgatcacgaataattgtttagtgggaaaatagtgttgcataatatgcaggaaccggacatcattaggatccttatctgggctccaagccatcacaacagcatcgacttgttgggcgtagaggaacaacgccgcgttggctgtggcggttttaactggaacaagcggctgacggccagtgacattttctttcgtccaagtgtgcgcatcggttgtgatcgttttgtcgccttgtgcgcgcaaaccagcactcacgtaaccattaccagctgccacttccaagtaccgctgaggaccataaagtcgatgccaagtcgcaaacagatcttcatgaacaaatgaccacatgccatcatgaaaggcaatgtagcggcggaaattatgcaataaatgatctagttgaagcagttcttgcagctgcgcctgtggctgggttaaagcggcatcaatttgcggcgtgctaagtcccaaccaaggtaacgcatgtgctggcaagacaccagccgcaatagatgcttgccaattcttcatggcagttagttgtgatttaagcggtccaatgcgcgcatattgtttggccagccgatttaatgtgctccaatagtccatgttcaccctcgtgatccatcgctttgactgcctgaaagacagtcaaaagccgccttaaacggcggcttttgcattccgtgtctaaacgccggttaatgaatgcccagcgccattttggcataccgactgaggcgttctggcccccatgctggataccaaactaaatgaatttcaacgctggtaatcccgtcaatcgttgtcagtgcccgtttaatatcagcatccaacatgtctgtcaaaggacagcccatcgttgtcaatgtcatttcaacggtacatttgccgctttcatctaaatcaaccccataaatcaagccgaggttaattaagtcgacaccgagctctgggtcaatgacggtttccaaagcgtcaagaatttgctgtttcattttatcaaaataagcctgatcttgtgaggctgcatgatcgctggtgtctgccatcgttgaacccttcccttctgtgacccggtactgattgctcaaagccagccgttaatccttatctgatgcaagtacaccggcaactgaataatgttccttagccatttcgttaagaacaatgtgaatatgctcagcgggtgcgccagtatctttgacaatggcatctgtcacgtctttcacaagggctttcagttgctccggtgaacggccttcaatcaaatcaatgtgtactaatggcatggtattcgctcctttggcggcaaaagccgacagttaatttgctttattttagcatgagtgtaagattttcgcacctatgctatgtgttttgctctttgtcaattctatttaaaaatcgcatttactggaaaatttttcccaatcacatgaaagtaaacggatcagtcgatagtttagatggtatggctttgacatcccatccttctgcatcggcccattcgttgatcaaagtcgcaactttgcctttcataatcgactcgatatggtggccgggatcgatcacgggcaggtcggctgctagcatatcgtgaccggtatggtaatacacatcgccagtgataaagacatcggcgccagcttgcttggcatcgttgaaggcatcaccgccatcaccgccaagaatagccactttttgaactagccggtctagatcgcgggcaaccacacgcaaccctttaacgttataggctgctttgacttgttcaacaaaagcctcaaggcgaattttgtctggtaacaagccaattcggcccatgttggcgccttcaccttcattgataaagggcacaacttgacttaatcccaacgcttctgccagccagtcattcatcccgtcttggacgcgatcaaggttagtatgcgctgcatagaccagcaagtcatcctttagaatttgggcgtacatggcattctgcggaacccgcaaatccaagttatgtactggtcgaaacatcgctggatgatgagaaaagatcatatcagcatgaattgcttcggcttcagtgaccacttctggccggacgtctaatgttacgaggacggttttaactggtttatctgggttacctaattgcagcccgcttggatcgcgttcccatgccaaactcaggggggcaaagtcttcaaatcgattaataatctgtttaccgctcgtcatgtgcgtctaattcctccttgattaatgataaaattttttcttgttcgcgaatcttttctagcggcaccatctgtgcatcagccaaaccttcaagcacagcctcggttttctcagcttcgcggtgcatttttttcataaaagttggactcttttgccgccgtaaaatcggcccgaagcgtaaatcagcttccgaataaggcacatccgggcgcgttcgaccagctgccatcagttcgtaaatatggccttcatcttcaacgatgtcctcgccgataatgccataaccatgctgatcaagccataaacggacatcgtattggtgtcgattgggagccagtaccaaggtttcggtcccgtctagttgtggctggccagcctcaagaatatccgtcatcagctgaccgcccattccagcaatgacaaccgttgaaatggcatcgtcaggcatgatacttgccaaaccgtcagcttgacggacgctgatctgcgcagttaacccagcatccgcaacgttttgcttggcaattgcgaccggtccggcgccaatatcactggcaatcgcaaaattgatgcgttgctgctgcaccaagtaaatcggcaaaaaagcgtgatctgtgccgatatccgctacccgttcgcctgcctcaataaaactgctaatggcctgaagccgttttgataaatgaatatgatccatgactatactttctcctcatctcgttaacagttttcattataacaaactacgccgaacagttagttaacttttctgaaaagcgggttacgtccttagaaacatcaaagatttccggtatttgaatctgaatgtgggtcttcgccacatgatgacgtacgaaaaagccgcctacctcactaatgaggcagacggctttatcagctaacaaacgttcattactcaagaaaatccttaagttgcttggaacggcttgggtggcggagcttccgcaatgccttagcttcgatttgacgaattcgctcgcgggtcacgccaaagactttgccgacctcttccaaggtacgggtccggccatcatcgagtccaaaacgcaaccgcaaaacattttcttcacgatccgttaaggtatccagcacactttccaactgttctttaagcagttcataggaagcatggtcttcaggactggtggcgtcttggtcttcaatgaagtcgccaagatgtgaatcgtcctcttcaccaattggcgtttccaaggaaacaggttcttgcgcaatcttcaggatttcgcgaaccttttcagttggcatgtccatttccgcgccgatttcttcaggcgttggttcacgaccaaggtcttgaagcagttgccgttgaatccgaatcaacttgttaatggtttcaaccatatgcactggaatccgaattgtccgggcttggtcagcgatggcacgggtaatagcctgccgaatccaccaggtggcatacgttgagaacttaaagcctttccggtaatcgaatttctcgaccgccttcatcagccccatgttcccttcctgaatcagatccaggaattgcatgccgcgaccaacataacgcttagcgatggaaacaaccaatcgcaagttagcttcagccaaacgttgcttagcttcttgatcaccttgttcaatcttcaaggcaagggcaacttcttcatcagctgtcagcagggaaactcggccgatttccttcaggtacatccgcacagggtcattgattttgacccctgaaggcgcggacatgtcactcatttccttcttggaaaccttcttttgcttcttcaagctaatcgctgctggctcgccattttcatcaacaatagcaatcccattatcctcgatcttttgcatcagatcgtcaatggcaccactcttgagctcaaacggcttaaccaacttgtcggtcaggtcatcttcagtaatttgtttcttcttcttgtaatctttaatcacggccttgacagcatcgtcgaatgctttcgttgtcgttttggtcgtgcgtttgctgctagcggtagtcttcttgaccgtagttttcttcgcggtggtcttttttgccgccgccttgacagcggttgtcttagccgcagtttttgctgctggcttagccgttgtcttctttgtggtcttgtctacttcagttgctgtttttttatcagccattaaagttcctcccctagccttgttgttgtttcaaaagtttcatgagattcacatactgcaccgttagctcgcctagtttctgcttatcgccaagtcgctgtgcctctgtgatggcctgcctgatagcctgcagccgttcgacagttgaagcggacgtgatcgtctgaatcaactcgtcaatcgttgcctcagtcgcctcaggcaaaacctgcatcgccaccgaagccgccaccccgctcagatctggatcgactcgatccaggaatccagctaactcgccatcaggctgctcatggagaaaatctagccatccggtaaagagcgtctgaaaatgtggcgctggaaatgtgaaagcagcattttttaaacgctgcatcactaaatcatcgtgccaaacataatacagtaattgtcgttgggctgcagtgtaacgatcaattggccgaactggttgattaaccggcgcagtttgatagcttacaggagccgacgactgttgcggcacggcttgctgcggcgctggcaggctttgattcagagcgctctcaggcacgccagtcgtgtcagctaactgcttcacataaattgcccgcgctaccggattcgaaatcttaccgatggtttttaaagccgcgttcagatacgtcagtttagcctgatcattgttcatgtcaaccccgcgcgctaagaattgcagcataaacgcggtcggcgtcaatacggatttgacttgcgcttggaaggcttcggcaccacgggcacgaatgaactcatcaggatccatcccgtccggcaaaacgaccacatccgtttgtaatcgcggatgatcagccaacatggcaaccgcacgttcaatcgccttttgccctggttcatcaccatcgtaacacacggttaatcgcttgcttaagtggctaatgatgtcaacctgctcagtagttaagcttgttcccatggaagcaatcccggtttttacaccggcttggtacgcagcgatcacatccatatagccttcaaaaagaatcgggccgccatcacggccaaaatcggctttggcacgatgaagattaaataggacatcacgcttgttgaaaagcttggtttcgggactgttcaagtatttagcttgggtcttgtccttgcttagaatccgcccggaaaaaccaatcacttgaccatgactgtccgttagcggaaacatgacgcgatcgttaaaccgatcgaacaattttccttcttgatcctctacgaacaaaccgctggcacgctgatcttgatagtcgactttgcgattattaagaaacgctactaacagattacgttcttcaggcgcataccccagttgaaaagctttaattgtgtcatcagttaagccacgtttgtgcaaataatcaagtgcagtctgacctttctccgtattcatcaaaatatgatgaaatagatcggccgtgtcttgtaaaatatgctgttgcttgctgatctctggatcaaccggtgctgcatgacccacctgaacatccagtggcatgccagcaaaatccgccacttttttaactgcctccgggaaggtggcgttatcatagtccatcacgaatttaaaaacattgccgccgcggccgcacgaaaaacagtgaaaaatctgcttaggttcattcacagaaaatgatggggtgtgttcttcgtgaaaaggacacaagccaaacagattctgcccggtcttgcgtaattgcacatattggccaatataatcagcaatattgacagctttaaggactttgtcgacagtagcctcaggaatcattccggcgatgtcagctcactccctttcatgacatgtgccgcagagctgtttgccagcctgcagacgcccaacacacgttacccgaaatagcggtaaaaagtcgcacttctgagttgaaatgcgactttttgatagtctatcggcataataatacaaaatacagtatagcctgtttaggcttggaatgcaaggctacttaacaatgacttgactcacatcgccaaattgcttgatcaatgcggcaagttgaagcaaagctgccaagcgattttggcgaatggcttgatcgtcggccatgaccattgtggcatcaaagtacgcattaattggatctgcgagtgccttaagcgcctgataatcggcttccgtcggttcatcatcaaacttcttggcagtcgccaccgttgcatcatacaactgaccttcgctcggattctcaaacttcgctgtatccacatcgacttttacctgctgcttcttggtaatccgcaacacacgtccaagtgcttccatgacaggtttgaaatcagtatcgtccgcgtgcgcagaaaggatcttggcagcatccaagataccggcaagatcggcatcagcgcgaactgtcactgcatccacaatgtcatggcggatcttctgaccttgcaagacttgtttggcacggtcaatcatgaatgcattcaaatcctgttgatgcgcagcaaaatcaagattattggtttttcctgctgccttcaaggcatcagcaatcgtcgtctgcagttcagcaacggcaaatggccaatcatgtttggcgatcattcgaacaatcccgtaagcttgacggcgcagcgcataaggatcgtttgagccacttggaatcagatcaaccgcgaaaaaactcattaacgaatcgaatttgtccgcaatcgcaagtacggtgccgactaagctttctggcaacgcaccatccgcagaaatcggctcgtaatgctcagcgatagcttgggcaacagctggtttctcacctgccaattgcgcataatgttcgcccataataccttgcaattctggaaactcaccaaccattgaagtgacaaggtcgaatttgtaaatcgaagctgctcggtccagatcagccttatcagtcgcagataagccaaaacgatccgccaacaaatcggcaataacccttgttcgggccattttgtcgtacatggaactgattttatcgtggaaactaacagctttcaaacgatcaacatcgtcagcaatgctgcgcttttgatcttccgcatagaagaaagctgcatcttccaatcgcgcggtcaataccttttcattgcccgcaatcacattggctaaatgatcagcattaccgttacgaacaccaataaacgcattgaccatctttcctgacgcatcccgcgcatagaagtaacgttgattatctttcattgaggtgatcagcacagcttcaggaattttgagatacttttcatcaaaattaccagcaaatgcagttggccattcaacaagattattgacctcttccagcaagtctgcatccagatcaatctgccattgatgatcagcggcaatttggtgaatctgatcgctaatcaactgcttgcgcgctgccggttcaacaatcacaaattgtgcttttaaggccgcaacatagtcggccgcattgccgagagtcactggtctgccaaggaagcgatgcccttgagtggttctgccagcgtcaacatccagcaacttcatcgggacaatcgcatcatccagtaagctgaccagccaatgaatcggccgaatgtactcgaagtcataagcgccccacttcattcgggttgggaaggtcaggcttttaatgacatccagcatacctggtaaaatagctgctgctgttttgcccttgattgccttatgcagataaacgtaatccacacctttgatcgttttaaagacaatgtcatcaggggtcatgccttggccgcgagaaaagccgatcgccgccttggtccagttgccatctgcatcttgcgcaattttcttagctgggcctttgacgtcttcttcgacgtccgcttgcttgtcagcgaggtcgtgaatcagcaatgctaggcgccgcggtgttgcatactggtcaatcgcgccgtgattgagatgattttctttcaaaaaagcgacggttttatcgtgaaactgttgcaaactcggcgtcaccacatgcgccggcatgtcctcaagcccgatttcaatcagatattgatgcgtcatgttattccacctccgtttgatgttgcagtaatgggaagccaagcttcttgcgttcagccacaaatgcccgagcaactttgtgagccatcttgcgaatgcggctcatgtaaccggcccgctcggtaaccgagacagctcctcgggcatccaaaagattaaaggtatggctgcatttaagaatgtaatcataagctggatgaaccagaccgagatccatcaaacgccaagcttccttttcataggcgtcgaagaacttcagcagcatctcttgattgctgacttcgaaagcatacttgctgtgttcgtattcaggttccttgaaaatatccccatacaaaacaccgtcgccccattcaagatcaaagacactgttcacatcttgaatataggaggcaagtcgttcgaccccataagtgatttcgctggtaactggcgatacttcaagtccaccgaccacttggaagtaggtaaactgactgacttccatgccgtctagccaaacttcccaaccaacaccggcacagcccatggatggattttcccagttatcttcaacaaaccgaatatcatgttccaatggattaatgccaagtgcagcaagcgaatccaagtaatattcttgaatattttcaggagatggtttcataacgacttggaattgatgatgctgaaacaaccggttggggttttcgccatatcggccgtcagctggacgtcgagacggttcaacatacgcagcattccatggttctggtccaatggcgcgtaagaaagtgtacggactcattgtccccgcccctttttccacgtcgtaagcttgcatgagcatacagcccttgtcaccccaaaatttttggagtgttaggatcatcgtttggatgtccatcttttttgtcatcattgcctctttcccggtgaattgaagtgggattggcttcgggacacgaaaaagtccctacgccaattaatggcgtagggacgcttatgcgcggttccaccctacttcagatagaaaaaactacctgcggcttcatcatttggttcgaaaacgccaatcacaacaaccgttatcaggcttacactttccccgactcgcttcaataggtttcgttgcgaccctttttctcatcaccgattcaatttccttattagtatagcatcgcggaaaaacgtgtcaagcagagaagagcgtgagccaccccggtttctggagtggcgatcgcgttttggagcaattgcaggcagcactatttttctattctcggtcgatagtttcttatactccgagttggctccgcggcgattcggggtggcgaccgcgcagctagagtggtcggcacgacttcgagccaacgcgcaaacccggcgcgctggctcgaagctcggccttggtctaagcggagaaaaccactccgctaagaccaatctcaccactgagcccatcgccgctccgccaactctctgctttctattttttgattcaaatcatgatagcggctgtctattggccaaattaatgaacagtcgtgtacaaaaattgcttaaacgccagaaacttcatcaatccgtttcttactgttcttccaaagctcttcaggtgtatacgtatccttatcgaaaagcgttaaggtgccgtcttcagaaatttttgcatctgcgccttcccatgcccacgccggatcaacgagcaaattggaacgtttgccttttccgcgtgaaggtgaccatgcatccaaataatctttcataaagtgggagcgcatgtagcgggtctgaccgttatcaaaagtgattgctaataaattggcagccatccgaacttcggtggctttcgggaatgtttctgacatggcactgcctcctcgtattgttagcgatggaatcgatgatgacctttcgtgctaaaagaaagcacttactacaatcacattatatcattataagccatttacgattcgttttacttaatccgaaaactctgaatcgcctggctattaatgcaccccagaaacttcataaatctgcgacttgctattgccccaaagttcctctggcgtgtaccgatcggtttcaaagatcgtcaagctaccatcagcggcaatgactggattggcaccaaaccaagcccatgttgggtcaactatcaatagtctacgtcttttcttgccttttggtaatgaccaagcagagatatattgatcaataaaatgtgatcgcatataccgtgtttgcccattatcaaattcaattgccaataaattcgctgctacccatactttcacagctttcggtaaggttcttgccatgacgcccgctcctctcaacaaaccaaaaaaatgctatgatctagtcaactgtttacgagttgaatataccatagccagcgaagatagttaatggtttctataagaaattaagaaatatggaataaataagtatcgttattccatctaaaagcgacatattacgatgattaaattaattcagtgtttgtttcggagagttacccagtcaaaaatatgttgatatcaaataattatgccactgatatcaaccatcattccgagtcatcaggcaggcgatcctgccattgatgcatctgatccaaaaaacgtttggctttcggggtcacaccgaccatatcagtgtagataacatccaaaattcgtcgtaattctgctttggtatcaggtttgacgttgatgcgctccactttgttgagatcaagcgtgctaaagcgtcgcaggtaaaaaatcgcccgcggactagcatgaagtcgatgcggatctttatcccagtgattttggcacagcaaaccgccataactttcggaaaaatcaagcggcaaatcggtgcgaccgtcaatcacacaaccgcgccagttaggctcaacgccatattctttaagcatctggacttcaatcacgttggcgataatctgtggatcgaggccagaatcaatgagatacaaggcttgtttgatttggttaaaccagaatccgactggccgcccatctggaaaagcaagatcgattaatccaaaaatataggctgcataagcattcaaggtaatgtcatcagaaatttgccgatattgagtcgcatttttgatggcagacaaataagatagaccggattcacgaacttcaccaatataatcagcgtgagtgaacggtaaaataccagcacctaaagtaaaaccgggcttacgggcccggttcaaaagaaacatttttttgccgaatcgatcggtcaaaattttgacaagcatatcagattcgcgatagttctggcgggacataaccagtccctcaaatgtttcagtctgcctaaccattatcgaagatccttcgtgttgtaccctaacgacttcagataagcattattatcacgccaatttttctggacgcgaacccataacttcaggttcaccttgtcgcccaacaggttttcgatgtcacgtcgggcgcgaatgccgatctgcttaagcatctgcccaccgcggccaataatgatgcctttttgactatcgcgttcaacgataatatacgcctcgatctgcaatttaccgccttcccgatctttcatgcgctcaacttgaacggcaacagcgtgcggcacttcatcgcgagttaattcgagaattttttcgcggataagttcaccgacaacaaaatactcaggatgatcggtgagctgatcttcggggtagtattgcggaccgactggcaatgcatcggtcaatgccgtcaatagctcgtcgacattgtttcccatcgttgcactaatcggaaaaacttgggcaaacgcatagtcatgctggtagctttcaatcaacggcaataaatcgtcaggttttactagatcaattttattaatgatcaaataaaccggctttttcacttccgccagttggcgcatgatatagccatcaccagggcctttttcctcgtccgcttcgaccatgaacaagatggcatcaacttgattcaaagttgacaatgccgctttatccatataggtatccagctcatttttcggcttatgaatacctggtgtgtcgacaaatacgatctgcgcgtccggagtcgtgtagataccgtttattttgttacgggtcgtctgagcctttggcgacataatggcgattttttcacctaaaatacggttcataaacgttgacttgccgacgttgggccgaccgataatcgcaacaaaaccagaatgatgttcactcaagcgttaagatctcctttcgaaaacgcacctggcagtaaagcctgtggcgtcgtttgaactgactgtccggcaacgttggcaagcgtgatgacagcattagggccaaagaattcgctaatgacttggcggcaagcgccacaaggggccactggtcccttggtatctgcaatcaccagcaattcatccagcttcgaatagcccgcgctgactgccgcaaaaatagcactgcgttcagcacagttactaagaccgtaactagcattttcgacatttgcccctgaaaaaatgcgatcaccgacacggacagccgcgccgacagcaaaatgagaatacggcacataggcattttctcgagccgctaaagcagctgtacgcaaaactgacaacttaccaactcctaaaaagggccaaaagtggtggcccaaagacataaataccggcgacgacggcaatcaacgacacgatgagcaccgcgccggcactcatgtccttaatcttcttcgcgcgcgcgtcatattgatcgccaacaataaaatcaacaacattttcaacgatcgtgttcaacaactcgccaagaaataccaacaagattgccagaactaacacgaaccatgaaaaagcggaaacttgtaagacaacgccggcaacaatgaccagagttgcactcagaaattcgcgcttaaaattattttcgtccacaaaaaacaccttcagcccatcgagcgcgtgacgggcactttggatgaaatgtttattcttgccaacttgcttatctggtaaggccataagctgcgaggattttcttttgaagcgggatcatgacagcttcatcttctggcttaatgtggtcgtagccgttaagatgcaagaagccatggacgacggtgtaacccagctcgcgctcaaagctgtgcccataatcctcggcatggcggcgaacagtcagtggatcaatgaaaagatcaccgatgttctttgccatgccaggtagcagcggcaaatcgtcttcgccctcttcaatcgcaaaactgataacatccgtgacccggtcggtttcacgatactcgcgattgatgcgctcaatctcatcatccccaaccaaggtgatcgacatttctgtgttttcaggcaacttaagctgtttgccgcaaaaagcgactagttttttgatgagatcatggtgcttgtcatccagcagttgatcgtcatcgaataattctaagtccatcccttactccttcgtcttcttctgcaactgcaggtcgtgtcgaccataagcctcaataatctttgcaacaaccggatgccgcacaacgtcctgtgccgaaaattgggtaaaggcaatgtgactgatacctttgagtaattgctcggcctgaagcagtccgcttttggcgttgttcggcaaatcaatttgagtgatgtccccattgacgatcatctttgagccaaaacctaagcgggtcaggaacattttcatttgtgcctgggtggtattttgtgcctcatcaaggatggcaaacgcattatccaacgttcgcccacgcatataagctaacggggcgatttcaatcacaccgcgatccatcagccgatctgtgtgttctttccccaaaacagcgtaaagggcgtcatataccggacgcaaatagggatcaactttttccttgaggtcgcctggcaagaaacccagactctcaccggcttcaactgccggtctagtcaaaatgatccgctcaacttggcctgccttcatcgcggcgacagccatgacaacggccaagaatgtcttcccagtgcctgctggcccaatgccaaacgtgatatcgttatgcttaatggcatcaacgtactggcgctgcccaaagtttttgacccgaattggctgacctttggcatcgcgcaacaaggtttcactgtacatatcagcaaaatactcaagcgtccctcgcttggccatcgcaacggcgctagcgatgtcctgcggtgacaatttaatgccctgagctaataacttactagccgcctcaagtaactgtaatgtcaagctgaccgcttcagtatcaccatgaatccgcaactcatccccaaaaggcgagatctgcacattcaatccttcttcaatcaatgtcaaattagcgtcattgatcccgacaaggttaatcgccatgtcaggattactaagacggaaaattttctccgaggtttcttgtgccaaatattggccccctaacaaatttattaagcaatgatgctctcagtttagcatattttaagagcgcgagcaggcgcggttagaaaccggagcataagtggccttgagactaaatgaccggtctttggtcatttagtctcaaggtccttatgtgcaggtttctgcgcctgctcgcgcgtttccaagcaaagcgtgaagcaatcgcctgaccacagttagacgatattcaacgcaaacccattcgtcagcaaaatcagcacccttatctgatcaccacgcacgccattcacccacaaaacccatataaaaaagccggctattgcaccggctttgtcgttaactaagtttttctttgaccacgctgctgacaagactgccatctgcttggcctttgacttttggcatcaacgtcttcatcactttgccgaagtcttgcttacccttggcgccaacttccttgatagttgcatcaacgatgtcaccgacttgggctttgtttaactgggctggtaaaaaacgttcgacgaccttgatttcagcttcggtttgttgaacaagatcatcacgaccgccttttgtaaattcagaaacgctttccttgcgctgtttaagttcagtcgcaagaacgctcttttcttcctcttcagaaaggtcgtggccgagtttaatcttttcattgaccaaagccgtcttcaacatccggacgacgctcaacgtcactttgtccttggctaacatgctttgtttcatctgagcgttaagctcatccattaaagccactattcaccaagtcctttaattaaaacttcttacgcttacgtgcagcttctgacttcagcttgcggcgtacgctaggcttctcgtagaactcacgcttgcggtattcagcgagtgtacccgacttggatacagtacgcttgaagcgccgaagagcgtcatcgagagattcgtttttcttaacaactgtcttagccatgtgatatccctccctccgacacttgtgtaaccactgacggatatcatagccaatagttcgtttattagtatacaaaactagcaaccacgcgtcaataagcgatttcacatttttgaataaacttgccctgttctgttaagttttttagttgtttttggcgtaaaatccctagcatcagcaaatggtcgaccttaaatagctaactggtctagacacgcttgtcaccattggtcgtcggctaaccgctcctgtttagttggtaaatatgctatgatagcgttatctaagtaatgaggtggcagtatgacgcaagaattaaatttatatatcatgtcggactcggttggcgaaactggcttgcggttggcgcaagctgtcgcggcacagtttcccaactttgaggcacattatgtccggttcccatttattcatacggaagaaaagatttacagcgcgcttgatgaggccaagaaggaaaatgccttggcaatcatgaccttcgtgacatcaggctttgctcaacttgcaacgcattatgccaaagatcaaggcgtgattgccattgatgtgatgtcgccaattttaagcgggattaagacaattacgcatgaggaaccaaatcacgttcccggcgctgttcatgatcttaatgaacggtattttgaccgcatctcagctatggaattcgcggtgctgtatgatgacggcaaagacccgaaaggctttctcgaggcagatatcgttttgcttggcgtttcgcgaacgagtaaaacaccattgtcattgtttctcgctaatcgcaaccttaaagtggccaacttgccgctggtacctaacgcccatattcctgaagagatctggtcagttgacccgaagaagattgttggtttaaccacggatgcctctgttttgatggaattccggcgccagcgaatgattgcctatggcttgaatcccgacaccgcttattcagcacgcgatcaagtcaatcaagaactcaagtttgcggaagatctgtacaaaaaaatcggctgcatggtgatcaacaccgcccaccgatcgattgaagaaacagcaacgcttattttggaacacatgggtctcgatgaatttgataatactgaaacccattaaaccatcaagtggcgtaactcatcgggctgaaagtcccctgtttttagccatttgatttctgccccgtatggcggtacctgatgttttttgtcaggaccaacatacggggtttcgagtatcttgggtaattcggtcaaggctgggtgatgagcgatcttgtttaaggcgtcaaacccgatcgtgccaaagccaatgttggcatgccgatctttatgactgccttggggatttttcgagtcattcacatgaatcacactgagtcgatcaaggccaatgatgtgatcaaacgcgttgagaacaccgtcaaagtcgtttttgatatcatagccagcatcattggtatgacaggtatcaaaggttacccgaagcttttcgttatgtgtcacaccatcaataatggcagctaattcatcaaaagagcgcccgatctccgtgcctttgccagccattgtttccaaggcaatggtcactttttgattaggatcaatgatctcattaagccctttgataatttgttgaatcgctgcttccggaccagcgccgacatgcgcaccgggatgaaaaggcatggtataggcatgaagagcatctgctcgagcgacttcttctcgcatgaactgcaccgcaaatgtaaagttttccggtttcttggtgttgccgagattaacgatatacggggcatgaatcacagtatgactaatgccgtcttccgtcatcgctgctagcccttcaggaatcatcatttcgctagttggtttgcgccgcgtgttttgcggtgcccccgtatagaattgaagcgtgttagccatataactggcggcttcttcaacggcaccaagcaacatttttgaccctttcatactgacgttagctcctattaacatgtttccctcctaattaattgttcgtttttgattttgacaaggtgacctgccgatgtcggatacgttgaacgattccgacaggcacggcttgccaatgaaaagcccggaatcgctccgggctaaatctgatggtcttaatccgttttcggctcataaaaatgacccagaattttgaccgaatccgtgatcgagacgaatgcataaggatcactgtggcgcatggcttgttctaaatcatacatttctgcccgcgaaatgatggtgaacagaatcgtcttttcctcgtgatgaaaggcaccttctgcatcgtgaacaattgtgatgccacgccgcattgaattctgaatctcattcacgacctgtcgcggccgggccgtgacaatcataacttgaagtcgttgctgccgcgtgtaaagcgaatccatgacccggccattgataaagatcgccaaagcagaatacagcgcatgcggccagtcattgacaaatccggcgaagaagataatcaaaatattgaacatgatattgattgtcccaaccgttcggcctgtgcgttttcgcaaaacaatgccgaggatatcaatcccaccggttgaaatattattccgcaaggcgaaccccgttccgagaccgttaacgaccgctccgaagatcccgcagacaatcgggtctttagtaagcggtgtaagcacgccgagcacccgaatcataatggttgaaaaaatgaccgccaagaacgtgaaaaaagtgaaccgatggccaatggctttccatgctaacacaaacaacgggacgttcaggaagaaaagcagcgtcccggttgaaaaaagatctgttgttgataacgatacaaaaggcaatgcaatcgagaaattaaaccactttcgcacgatcgttgccaataactgcgctagtccagtcaccccgctggcaaaaaccccacctggttcccagaacatattcagcgccactgccacacaaatactatagaaaaaagccgctgatagccgtgaccaattttggtgtcgtctaatcagcttatcaatctcttccatacaaaaaccgctccctgtcacccgtaataagtcgcgcatcaagtataacaagggcggtcctgtattgctaccatggtctttttaaaacattttaatgaacagacttaaagagatgtcgataatccccgtaaccttctttttctaagtcggccactggaataaaccgcaacgcagccgagttgatgcaatagcgcaacccgcctttagcagctgggccgtctgtgaagacgtggcctaaatgcgactcggcagatgggctgcgcacttcaacacgttccatgccaaaactttggtcgcggtgctcagccagtttgctgattggcttggtgaatgacggccagccgcagccggcatcgtacttgtcctgcgatgagaataacggttcaccactaacaatgtcgacatagatgccatcttgataaaagtcatcgtactcgccagtaaacggccgctctgtcgctgcttcctgtgtcaccgcataagcctctggtgacaagcgctttttcaagtcctttttgctttccttttcaaattgatctgacaattaaaacacctcccgctgtcttcattatagcgggaggtgttttaattgtcagcaacttaattgtggctggcattttttaaagtaacgtttactcagttaggttttcgtcgccttcatgttccttttcaggatcaacatcggctcgaacttcgataccgagatcttttaattgtgcatcagcaacgggatatggcgcactggtcatcggttcactagccttgctgttcttcgggaaagcaatcacatcgcgaatgttatcgcggcctgttagcagcatgacaaaccgatcgagtccaatagctagaccaccatgcggcgggaacccgtagtctaaggcatttagcaggaagccaaaactcttttgggctcgttctggggtgaacccgagcgccttgagcattttttcctgaatctcgcggttatgaatacgaatggaaccgccacctaattcgtaaccgttgagcacgatgtcgtaactttgggcatgtgcggcatgcggatcagtgtcaagcaaatgaacgtcttcttcatttggcattgtgaacggatggtgcgccggtacccaacgctggatgccttcatcatattcaaacagcggccaatcaacgacccagcaaaagcgaaatgcttgttcgtcaatcaaaccgagatcgtggccaaaatgggtccgtaaatagcctaatgcatctgcgaccaccttggccttgtcagcaacaaacaacaccagatcaccggcgttagcgccaacagctttcacgaggtcagcaccatcgccaaagaatttggcaatcgggccgctgataccgtctgacgtgactttgagccaagccaaacctttggcaccaaaacgcttgatgtagtcttgctgggcatcgatcattttccgagaatacttgtcagcgccgcctggtaaaacaatagcccgcacttggccgccattttgaacagcaccggcaaagactttgaaatcagaatctttgacgagttcagacacatcctgaatctgcatgtcaaagcgcagatccggcttatcagaaccgtatttatccatcgcatcctgccaagtaattcggtcaaatggcaacttgacatcaatgcctttcacatcatgcatcactttggcaatcaagccttctgtgatgtcctgaatctcttcagcagttagaaagctggtttcaaggtcaatctgggtaaattccggttgacgatcaccacgcaagtcttcatcacggaagcaacgcgcaatttgataataccgatcgaacccagcacccatcagcagctgtttgaacaattgcggtgactggggtagtgcgtagaagctgccaggataaacacgtgacggcaccaaatagtcccgggcaccttctggcgtgctggcggtcaatgtcggtgtttcaacgtcaatgaacccgttgtcgtccaaaaaatgatgcacgctgcgcatgatatgtgcgcgcgtaaaaatattcttctgcatttccggccggcgcaaatccaggtatcggtattttaacttggtttcctcagtgacggccacaccgtcctcaatataaaatggtggcgttttagctttgttcaaaattgtgatggtatgaacttcaacttccacgtccccggttttcatatctttattgacagcttgcggcttacgcttttttaccacgccttgcacttcgatgacgtactcagagcgtaccgaattcgccacagctaaagcatccttgtcaaattcttcagagaagactaattgcacaatgccttcacggtcacgcaagtcaatgaaaatcaaactacccagactgcgacgtttttgtacccagccttttagtgtcacttcttgatcaacatactcggcggtcacatcaccggcataacaggttcgtttactcattttattttgcctccattacttgcgtatagattttgccaaagtcggccagcacatcagcttgggggaatgcttgctgatcgcctgtggccatatttttgatttgaacagtgcctgcagcgcgttcgctttcaccaatcgtcaagacaagcttggcatttgctttgttggcagccttaaactgtcctttaggtttgcgtcccatgtaatccatctcgccggtgaagccttgttgacgaatggcggtcagcatttgcagggcctcttgatcggcaccttggtcaatggtcacaatgtacgcatctggctgcgccgttggcaattcgccttgcattagcaacatcaggcgctcaacacccatggcaaatccgatcccaggtgtctccggaccgcccagttcttcgactaagccattgtatcgaccaccagctaaaatcgttgtatagccgccgccaaacaccttatcatcggacatgacttcaaaaatggtgtgattataatagtccaagccgcgcaccatcgtggcatccacttcaaacggaatccccaatccctgcaataaggttttcacccgatcaaaatgttgctgtgcctccggtgtcaaataatccaaaatagatggggcattggccacaatttcctgatcatgcttgtctttgctatcaaggatccgcaacgggtttttaaccaaacgaaccttggagtcttcagaaagctgatctttgaaaggcgttaaatagtcaaccagcgctgcgtggaaggcttggcgggttgctggatctcccaacgagttgatcacaaatttaagatgcttggcgcctagggcctccagcaactgttttgccaaagccaacgtctcggcatccaacaccggtgaatcactgccaaatgcctcaaccccgatttgatgaaattggcgttgccgaccactctgaggccgttcatatcgaaacatcggacccaaatagtaaaccttataaggcttagcatgttcaggaccatacagtttattttctacataggcacgaacgacgccagcagtcccttcagggcgtaaagccatcatccggtcacctttgtctttaaaggtatacatttccttagtaacaatatcactagtgtcccccgcgctacgcgagaatacatccacattttcaaaaatgggtgtgcggatttcatgatactggtattgggcaaaaattttgcgagctacggcttcaacttgctgccagcgttcgctttggcctggtaatatgtcggctgtgccttttgggcgttgataattcatggattgcctcctgtggtttaagcactgtgatttagttggtgaagtgtgctggttccgaaacgcgcaaaaggacgcagaaacctgcgtgtaaggaccttgagcagtagtgaccaaagtgcaggtcactactactcaaggccacttacactccggtttctaagcgcgtccttttgcgctctaaaaaaatacacccctcgattgctcgaagggtgcggacacggtaccaccttgtttttttctttgccataacggtagcgttccggaacttgttcacctcagaagtgtcttttcgatcgttcccggctttcaccatctccgggtcgcttaaagtgatctatcctacttcttcacaggtcttagttattgcttaaagcatacggtttgttgaaagttttgtcaacgcgtttggcaagattttcacggttcattttcaacaaatctgttgcttgtggatattgtataatactgagtaaaaaagatgttagtcatgttcaagcataggcaaggagcgttatagcaatggcaagtaaatcagtttttgttaaagttgatcgcccgatcggtttttcagacaagtcgcatgcgccttatccgattaattacggctatgtgcccacggttaccggtggcgacggcgaaaagcaagatgtctacattgtctccgatctgattaatgaacccttgcaatcatttgaaggcaagttgattgctgttgttcaccgagcggatgataacgaagaaaagtgggtcgccaccactgaaaacgaaactttctcggcagctgaaattgccgcgcgcattcattttatggagcaatattttgactcgacggtacggttaatctgatttcaccaaaatcactctcaggtttatacctttaagggtgactttttgatttaaaatttgatcaaaatgcgtccatgggaatgttcttcaactagttgatgctgcgcttgtttgatctgctcgacaggtaagattgtctggacgtgcgcctgaagtgtcccatcgctgagccagttaagcaaccttttatacccgtttaacccaattgagccatttgcaaaccgaaatgtctgatcttgggtatgttcaggaaatgtcgttgttgaaagcgacagcagatcaaaatgccgggtggccgcaatgattgcctcgagtaaatcgagtcgtcccactgtgtcgatcaccttattagcatgtggcagatttgctaactgcgtagtgacatcagccgagtaatcaactaggtcatcaacgccgagctttttcagaaaatcaaagtttggtggtgaagccagtgcctcaacatgtgcaccgaacattttcaaaagttgaatcaaatatgtccctacgcccctagaggcacctgtcactggaccaatgatcaccactttttaacgcttcatactactttgcgcgtacttctatgacaatccagcaggccacagcaatcaaactataaacggcacctgtcaccataccaacaatgcttgtcgccagcggtagtggtccagtcaggccgcaaacgactaggaacaaaatgacagtccctagcagttggctccactggccggatttggtcaactgacccaacatgagactcaccaccggtaacatgatggcccagccaagtaacggccacgcaacgattccctgccgcagcaaggttggcagcaaaagtagtaacgaaaaggtaacacttaaccataaagtgctgttgatggcgcggcgagtcgcatggttcacggtaccttcccatgccgataaaccattcaaatcatcaggccaaccaatttgactgaagaaactcatggcccacaaatactgaatcggcaaaatcatcccgcgcaagctgccaactggcacaacccaagcaagaagccataaaccgatcgccactagccaccaccacttgttctgagaatggaaaagtcgatgtgcctgttggccaagcaattgttgccagcgaaaattgtccgttctggctgaagaaaatcgatgatcttttggccttggcaactcgacagttaattttgatttgcctgagttcgttttttggtgtagtggccggtgctccagacaaaaggcagccagtaacaccaacacgatgctcatcaacaccgtcccgccgattgccaaccattctgtttgtgttaacgccagcggctgaaaaattagctgatgtgtgcccatccgactcaaatgatcattgccgcccagcatcagcaccgtgttaagcggatgtccggcagaaatggcggactggcggatcatggccatcaagaacgcaatacccgaaaagttaaaaagttggctgtaccaagtcatggtagtcatcatggcatataacgtcagaagtgctatcactaacacggtggtgccgagttgtcctcgcagtcccggcaatgtctcactcaaaacccctaagccgctaatcaagaaaatcccaggcaccagactgaaaaaaggtgacaaaaattgactcaagctcaacccctgaccaggatattggatcaaaagcattagcccgctgccaagcatcaccaagactaaaatggtgaacaataggcagcagctaaccagaaattgactcgccaaataacggaaacgtcgtaattttgtcgtcaacaaatatgtaaggacaccattttcccgatcagcatgaataccttggcgcgcgatcacaaggctcacaagtggaaagaacaatgacaacacgcaagcaacaccgattggtaaccaagtgggattattggcttgcgcaaaatactgtggatccaatactaatacccgaaaattgccctttggccgcggtgcaagaatgacagcagcaaaaagtgctatcaccgccaaaatacgaaatgagaattgttgggtgcgttcccgataatcaaccgcaatgagtcgcatcatcctttcctcaccgcctgactttcaaagaaatcgagagtcgcatcttctaagttaggcgctaccatgaccgcattcgccaccggcgcctcgtctgcaatcatgcgaatatgaataccatcgcttctttcttgcatgccactaattcgctcacttgtcggcaaggacgcattgcgcggcagtgtgtattcccaaacgtgccccgaagctttgtcgagaaattgtgctggtgtgccttgaaaatgcaattgtccatcggtaagcaataataactgactggcaatggcctcaacatcttcaataatatgggtcgaaatgatgacaattcgggtttgcgcgagactgctcaataaattgcggacagcaattcgttcaactgggtctaggccaacagtgggttcatcaacaatcaccacttgcggatcacctaaaagactagcagtcagcccaacacgctgacgcatcccacctgagtaatcaccgagcaaggttgaattgctgggattcaaatgcagcagtcctaacgtttggacaatttgccggtccgcctcgcgaggagcaatgcccttaagcgccgcaatatagcgtaaataggccaatgcggtcacatgtgcatcataaggcacctgctgtggcagatagcctaaaacttgacgcattttttgcggttgcctgacaatgtcaacatcatccaataaaatcgtgccactggatggttttgccaaagttgctaagagtttcagtaaagtcgacttgccagcaccatttggtccaatcaaaccaatgaccccattggcttcaagtgtcgcggttatcccagtcaacgcttgtttatccccaaagcgttgaccaacgtttttcaaaaataatgacatgagacatgcacctcctgaaactagtttaaaattaataacttatggcaacatcaatcataagttgcacttggcgtcagtctttagactgaaaaagaatgagacataattccttattggacttgtgattcattagattctgaataatctgggaaacgtatagattagaattctttgccagttcggctccgcagcagtacgctatcactaatttcgcgcccactctactaaaacaaggaagtgtctttatgtggcaagataatcgtatccaagcagccattgatggtaccaatccaatggtcatggctgagctacccggcggatttgcggtatttggtgatgttcaatttttacccggttactgtgtgctccttccaaaacagaatattatcgatctcaatcatctcgaagagccagcaagaactttattcttacaaagcatggctcagttaggcgatgcggttttggccgcttgtcacccggtccgagtgaactatgatattttaggtaatacagataattttttacatgcccatgtgtttccacgatacaaaacggaatccgcggagcgacttgctaaacctgtttggttatacaccccggatcattggcacgatccaaaatatcaatacaacccggccaagcatgatgcgattcggcaaaaaatcactcagtttcttttggcataagcgcccgatccgactggtaagggttattccgaattgtcttgttgtctagtccttaacgcaacttaaacgtgattacgccactttttctaatgcgatttgctataataggattaactatcttcagaaaatggtgggctcatgaagaaaattggacaattaaaaaaatggccgctggtcgttctggtggcgctacttttcggcgttggtgttgcaacaaccagtgtaatggccaacacacaatacatgactgtcaaggcagataccgtcaacgtgcggttaggtcctggtttggcatattcaattatgggacaagtgaaatccggtaatgaactgtcgattatcggtgcgaaaaactcctggtatcaagtccgactagctggtaataaaatcggctgggttgcctcttggttggtggatcaaagtgaagcagcaacttcacaggccaaagtggcaacggttgatcaaccggttaacgtccgtgaatatgccagtcaaaatgcaaaacaactaggttcgctaaatgccggcgacagcgtcaaggtcgtctatcaagaaggcgcttggactcagattgcgtacaacaccacggctgcatggatcaccagcagcagcgttcagttaaccggccaaaccaccaatttagcccagcctgcgcaaacggcgttggcaaccgagaaaagtgcgccggcgctgaaggtaacaaccaatacgatgaccaaccttcgcaatgctgccggtatcaatgcgccttcggttgaaaagctagacaaaggcaccgaactgacggtctctaaacaacaagatgattggtatgcggtcacggcaccagatggcaaaactggctacgttgcgagctggaccgtcagcgcaccaaatgacgggcaaacgcaaaaagccgctacaaaactgtcagaggctacgattgtccttgatccaggtcacggcggctccgacactggtgcgattgccaatgatggcaccgactatgaaaaaacatacacgcttaagacggccaatttagttgctaacgctttacgcgcggctggtgccaatgtcattatgacccgtacaacggatactttcgttgatttagcacctcgaccaaatactgccaacaatgctcacgcggatgctttcatctctttccattttgactccagtccatccaagaattcagcatctgggatcaccacctattactacgacagcaaaaaagaccttgccttggccaagtccgtcaacagtgctttcagcggccttccgctggaaaaccgcggtgtcgcctttggcaatttcgaagtcctgcgtgataataaacaacctgctattctgaacgagatgggttacatcaacaacgataaagatttccgtcaaatcaaagatccgagctatcagtccaagattgctaccgatattgtaaatggcctaaacgcctactttaaggcaggcaatcatcagtgatgaactaaaaaaggtcctgacattgagtttacaacttcaatgcaggaccttttttagagtcgataataacttttaaacgcggaataatggcgggatctcttccagatgatccacctgaaaatcagcttgcggtgcggcgttcaagccgtcaacgttaaagtagatcgttttgacgccagcgttaatgccagcgtcaacatccaatgagcgatcaccaatcatcgctgtgacagccggatttagctgaaatcgtttgagcagatactgaattgaatctggtgccggcttgcgtggcaaatctaaatcggcatccacgccacccaaaaacaaatcagcagcatgatccttggccaatattttccaagcactgtggtcgcggtgcgtcaacaaaagattattcccgccttgcgacttgatcgctcgcaaaacagctaaggcagtcgggtaaggtttgatatcctgcaaataagccgcagcccgatggtggtaatcagcctccaaatcggtcacactgcggccgatctgtgccccaaatgtcgtcaaaaattgtttgattgaagtctctttggttgttcgatacaaagcggctaaatcaaagtgaccaccgttgtctgtcaccaaagcacctaacgctttcatcatccccgggtaggaatcatacaaggtcccgtcaaaatcccagatggcattgactagcatcatttcgcctccgtatcaaataaaatcgtaactggcccgtcatttgtcaggctcacctgcatatcgccaccgaactcaccagttgcaacaggcacacctaaagctttgagtttggcattgaaggcttgatacaaacgatcacctaatgccggatcagcagctccagtaaaactcggccgattgccgcggtgagtgtcagcatacaacgtgaactgcgaaatcgatagcacttggccacctacatcagctaaagccaagttcattttgccgactggatcactgaacacccgtagcttgctaattttttccgccaaataatcactgtcggcttccgtatcagttggtccgacaccgagtaaaaccacaaacccgtggtcaattgtaccgactgtattgccttcaattgtcacttttgcttcaagacttcgttgtaccactgcgcgcatgaattcaatcccctttatttgcttagcatgatcaaaaaagctgcttactcaatacggtagcagatttctgaccacctgtcttgagcaaacagcatttttatcgtcaaccagccctaaaatcagccattggcgcgctttacttcataaatatccggcacatttttgactgcatccatcaatttatccaaatgagcaagattgcgtacccccactgtcacgtgaatgtcagccattttgtcatggtcaacccggccgttaatgttgtttaacgccttggtctgggcatttagaacctgcaacacatcactcagtaaaccgctgcgattataaccgtagatttccaagtcagtatcaaaaagctgcttttgggcttcttcattctcccagcggacatcaatcaaccggccggccatttcaccggaactttgcacattcgggcaatcggcgcgatgcacggtgaccccgcgaccctttgtgacatagccaacgatcgcgtcaccagggacaggcatgcaacacttcgcaagatgcaccagcaggttatccacgccttcgatgacaacgccatcttcagaatgggtttgcggctgctgatgtttgtcgcttgaaaccgtcgtaaccttttgattcttggacagaatttcggcttctttagccttccggtctttttcagccttgtcatgccggaatttctccgtcaaacgattggcgatgactttcggggtatattcgccgtaaccaattgaactcatcaattcgtcaaccgtttgaaaattgaggcgctgcatcaagcctgtcatattttccttggtcaagaaatcttttggcacgtaaccttcgtccaaaagttcacgttccagcatatcacggcctttttcagcattctcgcttttatcagcctgtttaaaatagcgcttgattttattgcgagcccgtgaagtgaagaccagcttgatccagtcgcggcttggcgcactgccgctagccgttaacatctcgacaatatcaccgtttttcaaaacataattcagcggtacgattttgccattgaccttagcaccgaccgtgtgattaccaacctcggtgtgcacaaggtagccaaaatctaacggattactccccttaggcagctcatagacatcacctttaggcgtgaaaacgtaaacccgatccgtgaagatatcgcctttgacactttccataaaatcggcagcatcgctggtttcatcttgaagctccagaatttcacggaaaatgtcgagtttcttaccggtcttatcgtactcaaccttgctggtctggccttctttataagcccaatgtgccgcaacaccatattcagccacatggtgcatttcttcggtgcgaatctgaacttcaagcggcttacccatcggtccaatcaccgtggtatgaatactttgatacaagtttgccttgggcattgcaatataatccttgaatcgcccaggcatcggcttccacttagtatgaatggcgccaagaactgcataacagtctttgatcgtctcggtaatcacccgaatggccaacaagtcatagagttcatcgaactgcttatgcttgtcgcgcatttttttgtaaattgaatagatgtgctttggccgaccgtatatctcatatttgatgtgtaaatcagtcaaggccttttcgatttcgtcgatggcttcctgaatataagcttcacgttcggtccgcttactattcatcaagtgggcaatgcgatagtactgttgcggattgagatatcgcaacgatagatcttcgagttcccatttgatggtactgatccctaaacgatcagctaagggtgcgtaaatctccaatgtttcgttggcaattcgtcgttgcttatcaggccgcaaatgttgcagcgtccgcatattgtgcagccgatcagccagcttcaccataatgacccgtagatccttggccattgccagcaacatttttcgatggttttctgccagctcatctttatgggcaacataggtcactttgcttaacttggtgacgccatccacaatgacggcaacatcatgaccaaacacttcttcaatatcgcccaaagtaatattggtatcttcgacgacatcatgcaaataaccagatgcgactgttgctggatccatttttaattcagcgagaatccctgccacctgaatgggatggataatgtacggctcgccagatttgcgaacctgatccttatgaacatatgcggcaaacttgtaggccttttcgacgaatgccaagtgttcagggttcatgtaagccttacacaacttcatgacatccggttgggtgagttcaacttcttcggccattctattccctcctgaattccacgccttcacaggcacgcgcacgctgatattatgagaagggcgataagcacctgccaaaagaatcttaggcaacacgcttatcgccgcttcgctacgcttgctgtttcgcgtcagtgcgcgcttttatctcaacacaccgttttcaaaaagcagtgtgcgtgacggttcacttttcttagattacccttaaattataacgattctatgtaaaaatgctagtcctttgccattgcgagcagactgagcaaaatatagaccggcacaaagaaatagccataccattgataacgcaaaaaaaccatggcggcaaataaaactggcagaacgaataaccaccaccaagccaaatgatgccgatgaatcatcttaccaatccaccaagcactgaacatatcgatgagaataaacaaaacaccgacacgaatcgctgtgctgatatgaaataacggaaatagccacggtaaaatcaaggtgatcagaatgctccaactaataacactgttgcggggcactttgacccaattgagaatacgactcatatgaaaatgttctcctttaatgacacttatatagatgttgcttgtaattctgttaaaaccgacacggcactaagcaagtaaagcggtgcagtttctgcacgtaaaatgcgcggccctaatcctgcagcaataaacccctgccccgttaaaactgataattcttctggtgcaaggccgccttctggaccaaaaaccacacacaacgaagcaggccgaggcgatagcgccgagattaaggcaccatgctcaccttgtttggcactttcctcataagcgaccaatttcgcctcggcagtctgccctacctgatttagcttagcatacatcgtcacatctggaacccggtttcgatgactttgttcggcagcatttttagcaatttcctgtaaacgggcgatttttttaacaacccgttccgccggccaccgtgccgttccccactgggcattgaaaaaaccgattttgtcggcacccagctcagtagctttttgaacgatccattctgatttgtcccctttgctgacaccacagacaacttccacagccagtggcagttcaacttttttagttatgtcttcatcaatcgcgacctgtagcggcgacgactgctgaatgattgccaaatatgcgtggtgcatggggtcaacgagttcgaaccgatcaccaatatcctgacgcagcactttgatcgcatgtttggcaatggtcgcatctaactgaacaacgtcaccggttttaagtttttgatcggtaaaataccgctgcatctgatgtcctcctcataaacgaatcgcaagcactagcgcaaaaagctgcacattagaaccttgatcagaatcgtcaaagcacggccattccggccaagaacgctcattgctttgattgctaaccgtgccacctcacgctgtttctttaatcactgcgtctaatgcgacccaaccaccggcttcgcgccgctgagcaattgaaaagccattatcttctaaagtccgaataattaacgtcgccttgtcggcaataatgccagcaagcaagaagtgcccatgagcttttaatcgtggtcgcacttgcggaatcagcggcaccagcacttcggctaaaatgttggcaacaatcaaatcggctgacaaggtaatgcccttcaacaagtcattcgcggtgacagtaatgtggctaaccggatttagcttgatattagcctcagcatttctaacggcaatttcgtccacatcggtcgccaaaatgtcaccgacaccaagccgttcagccgcaatcgctaaaatacctgagccagtgccgacatcaatcatggtttcaccaccgcggatcacggactccaataacgaaagcatcagctgggtcgtcgggtgtgtgccggtgccaaaggccataccgggatcaagtgtcaactgcaattcgcctgcttgttgcggcgtataatgctcccacttgggtacgatggtcaaaaatcgcgaaacgcgtaagggatggtaatactgtttccagacatttgcccaatccgcctgcctgacatctgccaaggtgacggttgcagcaccgggatccaggccgaattgagcaagcccgcggacccgcgttgcaatatgatcgcgttgttcaacaagtgatgttgctggatcaaaatacccaatcacttgtgctccggaggccaaatgcggcaccgttttcgggtcaaaccaggtaccgtgagcatccacggtttcttttttgaaatcagcggcgtctttgatttgaatcccaaccgcccctgcctccattaaaatattgctgaccgcctcaatggcttcagtggtggttgtgaccgttaacgctgtccaatcattcatggttgcctcctttaaacgtgttctttgatgcaaaaactgctactgtccagataccggcttgaaaagtcagccgaccggtccttgcagccaatattctttcttctttggcaggctgactagtacttgggatagggtaaaaagacgcggttatcctcctccggctgttccgccagaatccgttcaaatgccgcatcgtcaaaattcaagacgaaagtatcatcgtcagacgtgccatcgacaaaatccatgaggtcactttcgctatcgtctaagaaatcctgcagatagataaacaaagcatccactgtggctttatcaatgcccttctttccattaaacccgaaaacagctaaataatcatctgcatagtcttcaccgtgcagccgggtttcatcataaaataaaatggcatcttgatattcaactggcccattgtcaacggtctcaccagattgatcttcaacctcgataccagactcgctttgtactgtcatcgtgatttcaagttcaatcacatgggcatctttatcccagtttagacttaaatcaccatcgaaatccagcgcatccattttgtcaccaattgcatctaacatattgatttggctcatgattgccatcctctcgtttttaaatcctgatctcgccgagctgtgcctgatacaaacggattcccctgcacggaaaaacgcaaaggtgcgcttgtccaaggttctttgtttggaatgccaatgcgcggtcctattgtgatgtgacgcggctgaaatgttgtcgccgtcagctgcaagccgccagcgtttaatcgactgccgtcaagcgcacggtcaattgccaatgcctgacaaagcttgcccgggccattggtcaacccaacgccttcttggtgccgacgttgctgcattttcgccataccagcttgcggctccagcgcccgaatcaagatacactccggcacctccgcagttcgcgtcacaatattcaataagcagtactggcgcatttgataaacataaacgttgcccgccggtaaatacagactgtgattacgcggtgtttttcgaccgccaaacgcatgcgcggctttatcctctacacctaaatacgcctcagtctcaacaatcaaaccactgcagccagccagactcagttgcatccctagcaattgctgcgcagattgaattgttggctgggttactaaccatggtatcatcatgcttaacatcttagcctagctgcgcgcgaaatcaaagaggcagcacagctttgcctaaaaatctttgccgggtataatggtatcaagttagaaaggaagctgaacatggcagaaaacttggcattgcgcgcattaatcagccaacagacagatgcactcgtctctgaactctataccgacgacaaggtcaatgcacgactgcagacgtggttagcaaaagtacctgatcctggtgtagccgatacctacagttacctactgtcggaatctcgcgatttctctgaggaacttctctatcgcattctgacaaagcttgtcgaggatggttcgctcaaactcaaggagcaagcttagtaaaaaataaaaagaacgaagcagtcagctcataatgagcctgcttcgttcttttttgccagttcccgtttactcaagcttagaaagcactgaggcagggatcgcatttttattcacaacttctgcgcctttgataacccgtttctcggaaacagttgctttcacataagagccaggctgtagttcagttggatttgcagattcgccagactcatatccaacttcgcgtttttgaccatcctttgtcacccaagtgaactcataatcataatagtaatactgtttaccattaactttataaggggagccatcattatttttggacgcatgcttggttccttgtgtcacctttgcataggattcaacgccattataggtgctgttccaatactgatagccgaaaaagcccaagacaatgacgaccaataagaacacaacgccgaatgcttttttcatatttgtttcactccttctcgataaaaatagtatgccaaaatcgtgacctggattcaacactttcaacggcttttacggctttcttaacgcgtgacaaaagtgtaagaaatgtaagcttgatgcgggttaaagccattctgtaatgctaatgctttatccatcagcattgcatatcatgagatttttaaaaacaaaatggaactaactgaataattaattttattactaatattatttaatgcgtatgtcactggtatgtaagaagacaacttatccacgagggacatcgttcacttctcttattgataccttgcgaaaatgtgatggttgcttaaatacaatttctatatcatctcatcgaattccttgacggcttattgaccaaaaaagtgttggcagtctttaacaaatcaaggctgaaccaacacttttgtaataggtgttcccaccccaaaccagatttaatgtcgcttaggttgccgcgaatcatcttttcgcggcttgcgcttcaggcggctgaaaactgactgtacggccttaaaccgttgcggatcacggcgagcatcctgcacgaattgactaaaatcatgatcgccgatgccaatctcaggcggttcttcttttttatgctttaaccaggccatcacgacacctccgaattattatggacacgacgagatcgtttggcgcctgacaaaattaagaacatggcaacagccaaaccaatgactgcaaagacactgtagttcggaatcagaatgaaggcaataaaggcacacaagcctatcagattgcctattaaaagcagccgttgattctgactcgcaaaatacgacagcaaatgtaagacgatcccaggcaacgtcagccaccacaaatgattggcccactgcatcagtgttgatccaacacccgtcaatgagaagccgtttggcaatgtcgccatgatggcagcaactagcattaccaaggcaaaggcaccatataagaggtcatacagtgccggtactttcttaatggaaattttcaagtgtcgaccttcccttgtttagcgataatcgtattatacaaggttaaacgtggcaatgcacggaagatgaaaacgacttaattaaaataatagtgtttcgcgaacggttggctattaaaaatattgcttttggttttgcttgaaaaatctttgttctgtggtttcgagtccagacgcacactcagcgaaaagcgtgttgaagatataagaacagccctacccgactgagatcaattaacgcgatcgacttcctttaaaaaatcgtcatatgctttattaacacagtaacaaatcgtctaagtaaaaaagacactgggtgagaaagatgctcgtcgatcggcgtcatcttattatatagaaggccaaaagcaagaaaaaaatgccacattaggtttataaccaaatgtgacacttcattgcaattaaagaaggagagtacaggatttgaacctgcgcgccggtattagccggttcgacggatttcgagtccgttgcattaccactctgccaactctccaaaacacaagaactagtataacaaaatagatcatctttgggaagcactccgtctgaaatatgaatgtttcgtcacagtcaacgtgctgccatctaaagaagccacaaattgcatcttaaagatgtaacttatggcttccttcatgtctatgtcttttgagcaacaaatctcaacgagcacacttcttttcactaacccgccgtcaccaatttcatccgccacaactcccaaaccgttaaacggcgcaggggtttggcggttttttgtgcgttctgactaatttgcgtccaccaatctttgtccgtgatcaaacgttgaatgaggccagcgagttcgaatgtgtcctgattggcttttaagatacccagttcgcctttgtcagcaccgccaagcggatcgcctgtgaaggtgataatcggtgtgccgtgtgccaaggccgttagtacgttatcatccttcagattggcgatgtctggcacgatgaaggctgctgactgctcaagtgccgaggtttcttggattacttcgtcttgaatgcgaatgagctgattcagtcctaactgattcacctgttgctgaagctgctgtttaagcggtgaatctgggcgctggaagaaaaaagtgagtttcacttgctcggctttgacccggactaaagacagcgcgccaataagctgttcaaaattcggagcatgttgatcgtcaatgatcaatgccaactgccccgcttggcggtcatcccattcaggtgcggttgccggttgatcgaccgaatcatcccctgctgcaattggcaagagttgaatgccgacatcagccaagagtgtcgcgtaatcggcttttggatcaatcacaatttggacaatttttgagcgtaaatcgggctgttcaagcacctgcttaaccgcctgcgcatcatgctcattgcgcacaacaggcgttaaacgggtgatggcagtaagcttcaccagttcatcgaggctcgttgcaggatgatcgacaatgacctcacctggcgtattttgcacggtccggcctagcgcaaatgttgcaaacgccatccagttagcgaattccgcggtctgaccagcgcgatctaagtaagaaatcttatgaattgtgccttgctggtcataatcaatcgtcaacaaagacgatccatcaatttgaaaatagacggttaaccgtaagttaccatcagcgcgaaaataatgtgtactgattttgttgccagtgaggtcgtattcctcagtacgtaaccgatcgccgtgctcactgaaatatgagatcgtccgaatttgatgcaacacggcctgcccaccagtggttgccgtgaaatacctaattttcatgaccaactgctcaccgtcaaaaaaagcagtctcttccccattttgtcgcgcctgatactgcgtaaaagtttgaatatcacctgttgtataaggcacccgaaccgtcgcattggtatgtggcacgatagctgtgaaaacggactgaatctgattcgcagccacttgcgccaagtctttttgctgagacaagtcaggctgatagtctaacaccaaaatttttgcatcctgttgattatcgctaaacagcgtgaggcgctttaattgttcaaccccaacaggatcattcacgtcaaattgattcgttacaaaataaaacaaggcagattcctccttcatcgcacaagccaagatgatgattccgctgaaaaggtcgccatccccgccagtgttataattagcacctaatggcaaactctgaccaacaaggcgcctatttagattcaattttggatattttaaaaggccacgttctcgcccggcaaacattttactttcagcactaatcgcacgctaagcgagttcatgatcgattgaaaccggtcatcgaaaatgatgttcattaataatttaaaaataacagaatggcggccatgatgcgagtatcttggctcgacaatatattttgccgttaaataactcattttatataaaaataatcaaaagaatatgacactcatttaaatttcgctgtgaaaatgttttaacggtatgtccttcttaatttcatgccattaatcatcattgatgatgtcggaaacttctaatgtcttcagatcatataaagctacttgtaacggtatcagctaaatctttttgccaacgaaatcctaccaaaaagctaggtcgtttcgatactgatttctttttcattgccaaccatcacgttataattagcctacaaatattaattctttggagggaatttaagtgatacgatatgggacaattggaaccaataaaatcacaaacgaattcatcgaagcagccaccatttcccgaaagtgggaactcacagcggtttatgctgacgatgccaaggacgcacaagcatttgcggaccagcagtccgcttccaccgctttttctgacctgaatacttttttgcaaagcgacggtcttgaggcagttttcatcgcctcgtcgccaatcaggcattttgagcaaattaagcgagccattcaggcagataaacatgtgattgtgcagccgcctgccgtcacgaatcctactgagtttgcggctattgaacagctacttgccgatcaccctgacgttcggttctttgaagcagtctatccgctgcatatgccgaattttgaaaatgttgcggccacactggcgaccatgccagccattcaaggtgctaccttcgttgccatgcgtgatcttcccggttatgatcaagtccttgccggtcaacaaccggatggcttcacgcttgcatcagctgggggcgcgctgcaaattgttggcctttacccgttatatgccgccttgcgactatttggccgaccaaagaaagggagttattttgccaccgccattcagactggggttgatggtttaggcgccatttttctggaatatcccaagtttgatgttaccctccacatcggcatcaccaccgattcattcatgccgtcagaaatttacggccttcatgaaaaaatcgtgatcgacaacatcactgaattaaaactcatcaatcattacgatgtcgacaagcaaaataatctcctcaataccatcacttacgccaatcgcctaactggggaagcactggcaatcggtaatgtcctcgaaaatctcaacgatcctgaacaacaaaaacaatatgccagttggttgcaacttgcgcgagacgtgcacacgacactgttccacttacggtcaatggtcgggattaagtttccaactgatcgttaaactgccgaagattacccactcatgatcgcgatcatcatcaaaaatggcttctagaggcaaactgcctgtagaagccatttttgcgacgaaaaacaactcaccaccatcttcatttgacggtgattgaaaccaacttgcgcaaaaaacgaattaccccttcgttttcacccgctgatcgccaatcccctcagtaatctcatcaatgtggggcaactttttcttcttcgcatcatccaaaagtgcttgccatgcctgccaaacattttcttctgaataacgatctgacaattcatacgaacgtgttgacatttgctgtaattcatcgggatgggtaaataactcaacgaattttgctgccatggctttgataccttcgaatggcacaacgaaaccattttcgccgtcaacgatcagttcatttggcccataattaacatcgtaggtaacgccaaccatgccattactgatcgcttccatcaatgacaaattaaagccttccatgaccgatgccaacgcatagacttgtgcttcacgctgaacggcaccaacatctttcacataatcgtgtagcttaacgtcgtcttccagatgatacttcttgatcgctgcattgattttcgtcattgcttcatcattgtcacgatggtcaacgtaaccatagacatcaagtgaaatgttagggacatcttttttagcaatcccaatcgcttcaatgatatgatcaattcgtttttccggcgcaacacgtgctgtgaccaacaccttggctggctgacgatctgccattgcaacgcgcggtcgggcaaattgttcatcaggaataacgccaacggggatcgtgaataacttactttctggatggaagcgttcgcggacatcgtgagtctgtttttcggtagctgaaaccaccgcatcataatcatttgcatggatcaaactgtactcatagaagttattcataaccgaatgcattgggtcttgcgcatccccagcatgagaattatgcagatgcataacggtataggctgggcgcgcaaggttaaccagttgccaatcgccgagatgcgatcgatcgatgatgaaaatgtttggccgcttgtcatcccaatattgttcattcaaccggttataaaaatgcaaggtcagttcgtcaatatcagaaaagacgtaaacagcaccattatcttccgtcagccgccagcccgtttttgtgaaaacgtgattagcatcgtatttgttaaaggtttcaaggactggccgaccatccaccttatgccacacttcagtcccaattttgttgtctggcgtataccactgggacaaagacatgaaaccgcgaaaatcgtagaaatcaacccggaaaagatttccgaacgcgtcaaactgttcaatggagctgacacgctcagttggatcatcgctaaaatagttcacccgcgcgacaaattggttcccacgaagcaccaaataccggaactgattcggctctttttggtagctcagattatctaaaccgaagtcaatgtcctcagcgtgcaagattttcgttggcacatcttctgcgtcttggaaataatcaaacataccgagaatttcgctgtcggcaacgtcattatgattcaggtattcatgcaagcgcggattccattcacggaaaatcattttgaacggttcgccatggtccctgaacagtccagcccgttttaactgggcatgttcaatccctgaattgctttggttaaaactcgaattaataaagaatatcattggtcaggactcctatctaagaaaaagattcgggacggttgccagttgatcttgccactgctgccaagctgctttagcatcaaatgtctgtgacttttgataagttgtgttaaccatatccgcccactttgcatttggtgttgcatctgtcagcagccttacaagatgatcagcggctgctttgctttcgcccaaaggtgccaagtagccactgacatccttttcaaccaacagattcaagccatatttgacattgtaggcaatcactgggacgccgtagctcatggcctgcaaaatattcatcccaaaagcttctgaagacgaaacgctgagtaacgccgctgccgtgccaagttctttggccaattcctcgtccgtctgataaccgtgatactggatagctgtatcaacacccagttccttgctatacgcaatcatgccattctcgacgtcctgatctgagacatacccataaaaatcaagatgcaaatctggcaactgcttctttgctttggcaaaaattttgatagcctcttgcggttctttttctggtgaaatgcgaccaagataaacaattttgttgcgatcccgttttttgatcggcactaaatcgtgtgcatcggcaaaagtgtcaggtacaacgacgacttccttaaagtggaagaacttgtctatttcggccttttgttcttcagtcgctaccatcacgccgtcaaagtcattgatgtgtgtggcaaacagcggcttcaggtagtcaacataatgcttggacccgccaactcgttctgggttgtgcgtgtgaacactatgcagatattgccatttggcggttgcctcagtgacagcggccacttcattgataagcgaaggccgatcgttaatcaagacacttggttcggctgctgcgatttcattcatgaagaaaatgaacaattcactttctgagttaaaccgccaagcacggcctttgtaatttaacagttgatacatggtattcatcaatgtcccattgacattcattctgacaatttcgagcttcggttcgcctgcagggttataaaaaacttgcggtccgatctggccatcaggatgaaaatattgcgttgacgacttaaaaccgcgccgatcccagacatccttagcgaccgtagcattcatgtcattgtaatactccagcgagccaaccaaaccgacagtagctggtgcaactaaggcttttccaacaaccttcccatgatgaagaatttgtgattcattcgcgtcaatacccacaatatggtaatcgaatttatcaatgacttccgtatagcgaatatcgatgtcttgcggcaccaccgccacagcctcttgaaaataattgtacatattcaagacatcagcctgttccaagccaacccgtttcaagtcgtcaatcaataatggattataattccgagtcaaaacttttgccggcacaccgttacgcttgaacaacgtcaatcgcttagcagcagaaaactcagttcctgagttcattgaaaaaatgttttcatttacaaaatagttcaattaaaatcccccatttctcattgcgtttacctcaaaccgtcaattgtttatgcttctggaaaatcgctttcaaaaacaggcacatcactcgatggcaacacgtccagcctatttaaggcaacgccactgtctgccaacgccttggcagttgggacagctacagctggttgggaactgaccgaggtggccgcctgattgccgcgttcagcacgtagcttggttaattcagcttctaactgctgctgcgcctgcttcgctgccgccaaatcttcctgggcgtgcttaagatcggtttcggcaatctgttctgccacaatttgcttactcaactcgttttggagatcagacttggcattaagcgccttgtctcgatcagactgggctgtttctaactggtttgctaaatcagtcttggccgcttccaattgctttgtcagatcagcttttgtagttgttagttgttgtgtcaaattggcaacttgatcctgcagtgtctgctccttttccagcaaagcctcattttgtgaacgaagcgttttggcctcttcagcggcttgccgattgctttcaaagtcagcaagtgttgcttgatgcttagccatcaaatctttgatgtaaacggtcgtcttcgaacgataagtgtgccactgctctatttgcgtggacagctgttcgtttatcttctgtaaaactgcaatttgcgtaatgagaatgctattttgtttcaacgcttcatgatattgatcaccagttgatttgatcgtcgattggttatccaactgcggtgcggcttcttgtaaaacaaccgcgggggcctcagattgttgctgcgtggcgctggccccagccgcctttacttgatggtgagtaacgacctctgcctgactggcggtagcagcatccgtattatccacactctttacaatcggatcaggcacttgttttcccgcgtcatctgcatggtgttcagcctgatcaggttggatgggggcagcagcatcttgcggttgactgacagtcgcttttgaaggaactgcctgatcgttcggcgccgctgcttctgattcattttgcacataaaccgtcaattgatcatctgcgaagcttaactctgtgcctcccgtaatattcattgaccaagtatcacttttactttcagttggttttaaaatttcattagcaagcgaggcaacactactcaactgatcaagttgttgcgttgacgcggcactaccaggtgcaagtgcctttgccaactgatcaacaccatctgccgggctaaaagcttgcttgccaccacccaatttttgccgctgctcacttgaactagactgcttggctagcgaatcgagcagattagccgtctccgaacgtgacttcttactaaaaaatcccatgctttcctccttggtaagttcatcaatcgacatggacgttttttaacggccaccaggcgattaataaagctctgtgcaatttatcgacataaaaatacaatttattgatattattgtataatcccccataaaaagcttgattatgccataacataatcttacatgaatgtggggtgattacgctaatgataagctgggttttgcgttattttctacttttggatccgcatgtcccacctgtgaccaatttaaatacgatcgcaaggttgcaagtgttgccgcattaacgtatacaaacgtgatattcggaagcggcacgctcaccggattcgtcatcgcattagccatcgacttcgctttcaaataaagcaagaagtccgtataaatcggtgcttcaaaggcataataatctgtaaactcagccgtcccagctgacgatcgatagaaactcaatcccattgttggcccgccataaagcaaattggcgcgatgcccataatggccatctcctaatggttccggattgtcagtctcatcgtaccaagccatcaccatgtaataagcaatttcttggttagagtgcatttggtcggtgataccggcattagttccgatattctcggtggcactgctgacagtctcatgattgaaactatcaacaatcgcccgcgcccgctgctgtgcccgcgccgtatcgctggctgaaatcgtcaaggttgtttggccatttaacgtccgaagttcattgacatattgaagaaaatatttcgaaatttcattttcatcaggtttaaaattcggatcatctggcaagtaaaccgttttggtgctggggtagttggtggtggagggaaaaaaggaagctagatgactttctttgtatccaccttgacttagatcgccactctccagtggaagtgtattaacaactgtcactttggccatattcgcaacgagtgtttttaactttgtatcagtaaaactaaaacggataaaataattacctacaactgttggattgaccgttccgtctattgaaatcttatcagggttaactgattccccatcgctattagtcgcactaataaagttattatttggcatccaagaagactttgtgagtaaaaaagtatcttttgtcttaattgatgctaaagcacccactgggacactgggtaaaatattttctccggcttgtttataatgaactggatcattattgtctgtgaccgtaattgaggagaattgggtaacatcttttccgcctgaaacatctttgaacccatactgaataaaatatgttccaactactgccgaattgacagtgccaacagtttgaatatcatctaaaccaacctcttgtcccagcgtatttctggcgcttattagattctctgctggggaccatgacgagtttcggcttattgtgaccccggctgtctgaatcttaggtgtctgtacctgattcgtttcagaaacagatacaatattctcttttttctggtcgctttctccagagtcgttcaattctttttttgctttgtccgtcacatctgtctgactgacctctgatgattgctgcttctctagcgctattttcccttcttcggaaacacgcctagctggggcagagctaattgccgatgcagtagagttcgttgtgttgatggaggagggaccactcggatacatctgattcgctgaagattgattagtggttgcatcaccggcaatcaccccatcgccatttgaagatgcatttacagaatgtccaatattgagggctatcaagctagcgaacactaagataagtcccgatgtatctaaacaccttctttgaactttagttaattcaacaattggaagatttcccttcaactttgttttattttgacgctgccttttccccatttacatccctccatccagtcaagagcccttaaaatagttaccataacgaatcaacaactaatttgactccgttatgtagaaaagaagtcaattcaattgatgaattgacttctttaattcctgaaaaaccaacaattacgaaagaaccgtgacagatgttttttcttcaatatgttgattagaaacaggatcagtaaaatcaattgtgatctgataaacacccgggcgcgtgagattaacttcaccagacaatccaaaaagctctaatggcactggattgcccaaagaatcgtttgcattaacaagcaacttttcaggttgaaaactttctttatttttcaacactaatggccttaattcaatttttgccttcatggttgtctacctcgtaacggtaacataaacgtcattcgtaacaatctcgtttttattagctgcattggtgaagtaatacctcagaatgtaggtgcccggaatagaaactgtaacagcgccatcaactgacatttgatcaagggctactgcatttccatcaccatcagttgcgctaacaaaggcgtcggctggatcaaaatgggattttgcttggatgacaacgtttttcgtaactagcttacctgcttttgaagaaatctgtgaaattgtgccaatcaaatctgaaatacccggcaattgagagattcccttcagaacgccgccagcatcaggtaagttgacttgaataccaaccagttgtaacaaccagccagcgacaccaccaataacaccgccgatcgcagcccctattggcgaaccaattaaactagcaatcgtgtctgtaagaggtgtgaaccagccgagtaggaagaattccagagggttaacaataggaccaagaccaatgaaaccagccgcaacagcaatgacaacggcaatcccttcaacgatcatccctaaggtataagaaatcgcccagttagcaatcgtgtggccaaccaaaccgccaattgttgcgcctaatgccacaccactgacaacattatcaaccttaccatctttggacaggccagccgccatagtagcgccgtagtatgctccaattgaggaacccacaagaccgcttaaccaaccaacaataccgcccgtccaaccaagttcagccaagttaccaccattggtaatccaaccgacaataggaatgataccgacaatcgagttcaggacagttgctggaacaccagcaactatccatgttgcgaacccgccaattgcggttgtaattgtgccgtagaatgcactgccaagcgtgccaccaatgacagattcaatcagttccccaacctggccaagtccagtcaaattcggtaccaacttaaccgggttgatattagaagccaaccaactaattgcgttccacgcaaaactggtaatactgctaagaatccctgttatgctaaatcctgaatcggctttaacaagcgattgtgcagtaacgctaatagttgattgcaactgtttagcaacactatcttgtgcttcagtaattgcggtctgcatcgccttgtaagaattggtagactcatacttttgcatgtcttgaataaacgctgagcccaatgaagtagcaaagaatgaagctgtcaaagactgagctagactttcatttgaggaagcgactgccgaagacattgccttgttgtaggcagcaaattcaggaatagcagcatatgacgagatggcagcaatcatttgttgaccgtcagcagtttttgcaaatgcagaaactgctgcagcactggccagagatcctttatcagctaccaatgatgcttgcgtcataaatgcttttccagcagctgtagccatgaacgaagatgtcgcactagcatcagcgacagaagcagctgctgtacttgatgataacgacccaagcattgattgaaaggctggatcattggcagttgatgattgaattgctgctaaagagttcattgcttggccttccgctgtcgcattgaatgaagccactaacgacttttgaagtgccacgtcagaagcagcagttgcagcagatagttgtgtctggaaggcaagtacctttggatcgttgctaagtgaaacagcagcactaaagaagttaacgccagaattgattttatctgcagcttcactcaaagtaattcgaccttgatctgttttggcaaaagaggcaagtgaagcagaaacgcttgtcaaattcagtgaatctaaagcaaccggttttgttactacttcagttgcacttgagttgttctttaaagtagcaagactagatgtagatgcttgtcccgcagaagataccacagggggttgaacttctctatcgctaacattaactctaactgtttttcctattttttccttcgtataagggtcaatgtactcgtatcgaaggaagtatgagccagcgtaagcagtggtaacagttcccgtcaaacttatgtcttcaggattcaatggattacctttactgtctgtgccaccaataagagcaatgcttgggtcaaaactgctttttgtttggacttgcacgtcgcgcgtctctaaagtttgcttgtccttcgttacagtcgcttggattgcattgacagaaggtgctacaagactggctgcaggggcaacacttgctgttacaactgaagaagcttcggatgactgagctgaatttgtctgcgttaacgcagccgttgactgagcgatggcattgggtgctacaaattgttgagcagctactgctgagatttgtggtgcaatcaaagcttgagaagctggtcgagtactaggctgagtattgactgccgactggctcgactgagaatcctttgcctgttgtgcttcggccgattccttattagtcggcgcttgatcaatggacgcagcaatcttaatagtttccggtgtcacctcgtcagctttaactgttttaccagaatccagcgctcccgcaccaatcactgtcacaatcagtgatgaggcaaagagccattttttcccctttttccaggatcgaaagttagcgcgcttaaccttaattttttcagtatcagcaaacgcgatgttttggctttttttcaaattaatccacccctttttcctttatcacaacttaatcattcgttgtaacaccgttaaaaacattgcttgctttaaacaagtcattgtttttgagtgttgtggcattctactgagttctttttaaaattactttttggttcgaaattccatggtttattaacggtgattggcgaagaaataatgactggcaacaccctaaggtgccgcacggggtaagttttgtttccctaccatatggatcaccctcactttcaatattgttacaatttagttttcatggcgccgttttgcacccattagtgccaaagcacccatcaatgcaacaccggctagtgctagagcaccagccgcatcggtttcaccagtttgcggtaacgtgtgatcgttgccgtttgctgtgcctgaacccgtgatgtcggctgtatttgtcttggcaccggcaccagtttcatttgcaacggtgtgaactgtgcctgcattgtcgccattctggttattgttgcccgtgttgttaccggtttgtgaaccattgttatctgtggttcctttaccgcctgtgccctgctgtccaccttgaccagtgccttgattgccatgatcagtcgttccatggtctcccgttgggttcgacttaccactggtaatctgtgcggcaagatcacgatcagcttgtgcacgggttgctgcgctttttgctgtatcagctgcagctgttgcagaggctgcatactgagcagcaaatgataatgcttgtgccgccttatttggatccacataatcgtgggccaattcttgtgcggcttttgcataggccgcgtatgaagcagcgtctttagcagcattagctgcaacaagtgctgcactggcagcatctgacttcagataagcaagtgaggtgttgtttggatttgcttgtgcaatgttagctgtttcgctagcagctttggctgcgatggaagcagccaaattggcggcgttaacagcactatttgctgcacttgtataatcactctgagccggatggttaacagtttcggaaccagctgcgtgtgaggatgcaagactcttagcagtatcagcagcggagcttgctagatcagctgaactcttagcacctgcagcagcactggaggccttagaatcatcaccagacttagcggcttccttagcaacagcggctgacttcgcagcatcgtcagcagctgacttcgctagatcagctgaactcttgattgctggatcgtctggatacttcttcccagcagaaccagcaacgtcagcactagaacttgcctgactagcagacttgcctgcggcatcggcataactagatgcagtatcactcttagacttagcctcatcctttgctttcgcagcatcagatgccttggaagcagcggagcttgctagatcagctgaactcttagcacctgcagcagcactggaagccttagaatcatcaccagacttagcggcttccttagcaacagcggctgacttcgcagcatcgtcagcagctgacttcgctagatcagctgaactcttgattgctggatcgtctggatacttcttcccagcagaaccagcaacgtcagcactagaacttgcctgcggcatcggcataactagatgcagtatcactcttagacttagcctcatcctttgctttcgcagcatcagatgccttggaagcagcggagcttgcaacagcagaagcactctttgcaactgaggcggcactggatgccgttgagtcatcgcccgcttgggctgcgctcttagcatctgttgcagcactggacgcgatacttgcggctgacttcgctgcatcagttgcactagagattgtcggatcattcgggtacttcgttgcagcagagtcagcaacatcagcactcgaacttgccgagctagcagctttagtagcatcactcgcgtagctagtggcagccgtgctctttgcctttgcagcatcagatgctttggaagcagcagaacttgcaacagtagaagcactcttcgcaactgaggcggcactggatgccgttgagtcgtcgcccgcttgggctgcgctcttagcatctgttgcagcactggatgcgatacttgcggctgacttcgctgcatcagttgcactagagattgtcggatcattcgggtacttcgttgcagcagagtcagcaacatcagcactcgaacttgccgagctagcagctttagtagcatcactcgcgtagctagtggcagccgtgctctttgcctttgcagcatcagatgctttggaagcagcggagcttgcaacagtagaagcactctttgcaactgaggcggcactggatgccgttgagtcatcgcccgcttgggctgcgctcttagcatctgttgcagcactggacgcgatacttgcggctgacttcgctgcatcagttgcactagagattgtcggatcattcgggtacttcgttgcagcagagtcagcaacatcagcactcgaacttgccgagctagcagctttagtagcatcactcgcgtagctagtggcagccgtgctctttgcctttgcagcatcagatgctttggaagcagcggagcttgcaacagtagaagcactctttgcaactgaggcggcactggatgccgttgagtcatcgcccgcttgggctgcgctcttagcatctgttgcagcactggatgcgatacttgcggctgacttcgctgcatcagttgcactagagattgtcggatcattcgggtacttcgttgcagcagagtcagcaacatcagcactcgaacttgccgagctagcagctttagtagcatcactcgcgtagctagtggcagccgtgctctttgcctttgcagcatcagatgctttggaagcagcagaacttgcaacagtagaagcactctttgcaactgaggcggcactggatgccgttgagtcatcgcccgcttgggctgcgctcttagcatctgttgcagcactggacgcgatacttgcggctgacttcgctgcatcagttgcactagagattgtcggatcattcgggtacttcgttgcagcagagtcagcaacatcagcactcgaacttgccgagctagcagctttagtagcatcactcgcgtagctagtggcagccgtgctctttgcctttgcagcatcagatgctttggaagcagcggagcttgcaacagtagaagcactctttgcaactgaggcggcactggatgccgttgagtcatcgcccgcttgggctgcgctcttagcatctgttgcagcactggatgcgatacttgcggctgacttcgctgcatcagttgcactagagattgtcggatcattcgggtacttcgttgcagcagagtcagcaacatcagcactcgaacttgccgagctagcagctttagtagcatcactcgcgtagctagtggcagccgtgctctttgcctttgcagcatcagatgctttggaagcagcagaacttgcaacagtagaagcactcttcgcaactgaggcggcactggatgccgttgagtcgtcgcccgcttgggctgcgctcttagcatctgttgcagcactggatgcgatacttgcggctgacttcgctgcatcagttgcactagagattgtcggatcattcgggtacttcgttgctgcagatccggcaatgtcagcactagaacttgcttgcctagctgacttggcggcatcgtttgcatagctcttggcatccccgtcatgaccaatagctaaactggaagccaaatctgctgcaacgctggcgcgatcagcggcactcttggccacagcagccgcacttgatgcagttggaatgtcgcccccttgtgctgcttgtttggcagtatcggctgcacttgaagcatcgtcagctgcctttttggcaacacttgtcgcacttgtaatagatgcatcggtcggatacttacttgaagctgagtgtgcaatatctgcactcgaacctgcttggctagcagccttaatcgcatcaccaatgtatttatcgccttggctagcaacagcagttgcaattcggtttgcatcggcagcagcacttgatgcaatcgcagcttgtgctttggcctgaactgcttcgcttaaggcagtatcagcaaaactacttgcagcatcggcggcagaactagctgtcttagcaaaactagatgcttggacggcaaaggaagatgcctgtgaaatgttgccagcagcgatggcactattcgcctgcgacgcagctcgacttgcggctgtgtttgcactgcttgtaacagttgccaaactagtggcagaggaaacatctgacaaggcttgtgccgcataacttgaagtctgtgcggttgcatctgcagctacctgcgcgagactcgttaatgagtcgttgttagggaatcggctagcagcactcgatgcaatagcatttgcagacttagctgtgcttgaagcggcactcgcaatggcacttgcattgttagcagtagttgaagctgaacgtgcaataacggcagcagcttgggcactatcgcttgcttgactcgcttttactgaagcctgatcgccagcacttgaggcgacggctgcaactgccttggcatgatcgtttgcgtcaacagcaacttttgcggcggaactagccttatacgcctcactcaacgcttttgcggcagcagaactagtcttgtctgcatagtcagaggcagcagcagcggcggaagcggccttattaccgtagctttgcgccgtaccgttatcccctctgctacttgcagcggttgcctgtgaagcagccgttatagcagcagcatttgctgacttaacttggtcggcaaaactgtttgctgcagaagcgtctgaactagcatcagtagcaaaacttgtcgcaactgtgttcgcacttgaggcagttttaacaagactagctagtgatgagttatctggataattgttggcagtgctagaagcattctgataagcagagcttgcaacactacttgctgtgcttgcaatatcgcttgcattgttagcaacagcactagctgaatcagcagtatatgatgtcgtgcttgaagcaactttaacagcaatatcacgcgcatttgagccggcagacacagcaatttttgcagcactgcttgctgctcttgcttcacttaatgcttggccagcagccgaactcgctttatccgcgatagatgaagcgattgaacctgcaatagctgcttgatcagcaaaagaagaagctgccgttagatcccctgcgtcaatagcgctattagccttagctgcagcagaggttgccttagcatttgcggaactaacaactgttgcaaaactgcttgccgcatcggcgtcggaacttgctaatgtagcaagactggcagtttgagtgtttgcacttgatgcaacagctgaaagacttgtcagtgaaccgttatccggataacggctggcagcacttgaagcatcctgataagccgaatcggcaacactgcttgctgtgcttgcaatggcacttgcattgttagcagtcactgaggcagtacttgcagtcactgaggccgagcgagcctgatcacttgccgaactagccttatcactggcagaagtgttgccactagtaatcgaagcggccagactagaagccgctgtgctggcaactgccgcaatacttgacgcatctttcgcagctgagcttgcctgataagcttcgctcaatgctttggtagcagcagacttgcctttatcagcagccgaggcggcagttgaggctgcactggaagcatctgctgcaaaagacgatgcaacagcgatgctgccagttgtataagcactattagcagcagaggcagcagcgctagcagcatcattagctgacgataccgttgctgcgtaactacttgccagtgaagcgtcactagaggctccagcagcataactagaagttaggcttgctgcactggaagctgctgccgaaagagatccaatagactgatccttcggaaatctgcttgcaatactggaagcaatatcgtttgctgacttagcagtacttgaagcagcgctggcgattgaacttgctgagttggcaacaaccgaagcagaatttgcaacaacggacgcggagctagcaaccgaagaagcgtgatcagcagtatcagaagttgttttagcaagatttgctgcgacgtcgattgctgccgcagcagcacttgaaccgattgccgccgtcgagttcgcctgatcagcttctattgacgcttgattagcagcgtcattggcttgacttgcgagatctgcagcagttgaagcaacagctgatgcttgagcgttaaaggcagaggcgtttggcaagtcacccactgcgatagcgctgtttgcttgtgaagctgcgagacttgcagctttattggcggcagttaccttcgcagctaaactgctagctgttgcagcatcagaagaggcgctctttgcgtaaccactcgttgcaatatttgcactcgaagcaacatttgacaaactcgttagcgatgaatttgtcggatagctgctgatcagtgatgtggtcacatcattggcggaactagcaacactgctagcggtgcttgcaatgatgctagcgttgttagctactgttgaagcagattttgcagcgacagcagcggcgctagctttatcactagcagcactggtatcttttcttgtatcagccgtcaaactggacaatctacccgttgcagaatttgcagcgttagcagctacatccgctgcagaactggctttaagtgcttcactttgtgcaaaactcgccgccgtgcttgtcttatccgccaatgaacttgcaagtttaccagcagcaaccgcctggctggcaaaagtaactgcagctgcgctttggccagcagcaatggcactatttgcctgagaagcagcagtcttagcaacatcattagctgagcttgtttgaccagcgtaactgcttgctactgaagcatctgaactggctttagtcgcaaagtcagaggcaacatcattggcgcttgaggcagttgtcgacagagcagccaatgaatcatcttttggaaaactacttgctgcactcgcagtcacattcttagcagacagggctacgctgctggcggtactagcgatagcgctagcagaatttgctacaacagatgcggtgctggcaacaacagacgcagactgagcaacattgctgccagatcccgcactatccccagcaccagttgtcaaccctgcggcgatgttgccagcagcagaagcagcatctgctgcgatgccagcttgttctttagccttaagcgcgttgctcatcgccgaacttgcagctgacttcgtttgattagctaaagccgccgcagtagatgcagcactagatgcttgggctgagtacaaagcaaccgcggcagaatcgcctttgttagctgcgctggtaacttgaccaacagcagcttgcgcctgtgatttagcaacgctcacttgcgttgctaaatcactcgcttggctagcaaaggcacttgcggctgtcgcataacttgaagtcaaactgtttgcaccagcagccttagcggccaaactaccaatagacgcattgtctggaaaagcggaagcaagaccggacgccgtagaattagctgaacttgcagtcgtgctagctgccttagcaattgcgctagcattattggcctccgcagaggctgataatgctacaccgtttgctaggctagcattactaccgtcagctgttgtactcccagttgtcgtacctaaacttccagcaatcttgctggcatcactagctgccgaaacaacgatcttagcggcatcactagctgcaagtgctgaactcaaagccgccgatgcagcagtacttgtttgatcagctaactgacttgcaagacctgcggcacttgctgcaattgcagcataagaacttgcatcaggtaaattcttcgaagccaatgcagctgttgtttgcgcaaccgccgagataacagcatcatttgcagcttttactttagcagcaagatcgcttgcttgggaattgcttgcaaaagctgaagctgcataacttgaagttgcggcagtggcgcttgaggcagttgctgaaagctttgcaagtgaatcattagttggaaacgcactggcagcgttatcaacaatcgccttagccgaagcggctgtgctgtttgcggtgcttgcaatcgcacttgcgctattggcaatcgttgaggctattgtggccttatctagcgcaatactgccagtattgcccgctgaagaagcaatacttcctgctgatgcagtactgcttgcagatccagtgattgctgctgcagatctgccagcattcagagcgttgtcagcagctgaagaggctgcataagcttcacttaaggctttgtcagcggccgcatttgcaattggggcctgttgactcgccacggaggctgcactagaagcaatcgttgcaaaagatgtagcatcatcaattttccctgcagcacttgctgcgttagccgctgtagcagcagaagcagcgacattattcgcggttccaacgaccgccgcgatacttttagccgcagcagcatctgaactcgcatcggttgcatagctcgaagctaccgcagtcgcactagaagctactttagcaagactggcaagtgaatcattctcgggattagccgatgcaatacttgctgtttgtgtgttagccgaattagctgcgctgcttgcactacttgcgatggaacttgctgaattagcctttgtcgaagcggcacttgcaacgctagcggcgcttgcggcagttgatgaatcagtatcaggattgagtgccgatttgaccgtcactaagaaataagacatgataacgccattaaacggacctattaatggttttgactggttcgtatcgatattgaattgaaccgcataaactcctggtgttttgtatgaaactgagggaatccaaattggaatattagcatcattaggccgaccaacttgattagccagaatacttcctacggtgcccgttccttggaatgtcaaaaatggacctttgatcgagctagaaccaaaaggtgttaagtcatgcgtgtaatcaatgttgttcactgcggtactggcaactatcgttaaaccagaagtgagtgtaaaggttgccaaacttccattaccgaaagctgtaaaattcgattggactactttatcaattgaagtatctcccgcaaaaattgaaacatttggtgcagtcacagtagctgaaccgcggctattcgattgcgtatacacaattgtacttggtgtaccagcatcatcaacaaccggcattgccgcaagcgttttagacacaattgcttttccaacgtcattaacggcagcagaagcaggcgtcacgctggaggctgccgcgcttggtgctgcactgatagggctggcagcactctcagttgttttggacgcagtctgcgttgtcacttcgggcgcacttgattgcgccgcttgtttaacaattggcgtcgcacttgatgatgttgcgggagcaactgaggctgttactgaacttgtagcctcaggtgtggctgacggtgttgctgcagaggcagacgccggttgtgtttgctcatggttatctgcttttggttgtgctgcaaccgtggccggtgctgcggttgtcgcagcggttggtgctgcaatggtcgctgcagaggcagctgtgctaggtactgccggcgcagtatgaattgacgctgccgtagccgcgttaataatttgctgatcatcttttgaatcagcgtgaactgactggccttcggaggataaaaggccagcaccaccagcaagcaaagtaagcgtgctaaacgcaaaaatccagcgtttgcccgctttgtacatcttgaaattcgttgtctttgctgacggtttttccttactaaactttcccatgtgctcaccccattctagtgaaaaataaactcatcatacgttgtgtgttactcgcagaagaatcgcgtgaatcaatagctgctaacccttgatacatcttttgattcattcccgccagattgtgacgaacggttaatcggtcatttggaagaagatgaatgtttaaatcatgacgcgttcccgacgacacttctgcaggtattttgacggttagtgcgagatcgttatttatttcttcgccccctatcataaaacgtattaaacccaactttagattcttgttcttgtttggtcgcgaacctaacattagattagtgctaaatatataacagaacgattaatataacaacattctattttcagaaacattttttataaaaaatggtatcgcattcaaaaccccctttttaaaggttttatagaattaaacacgaacgttttaaagtacataaataacataatgtctttttatataaaatcatttacgaaaaattgacgtctaaatttgccaaatcagattcaataacgcctattatttaactattatattagtttctcaggaccagtcttaagaaacttttctgaattttatttacttttatgttcactaagttttctaaaccgcccatatacggttgttttccacctatactagtttctctaaaatttaaatgatggtttatagaatgccataatgattttataagaatttgacaaagattagcgtttgtcatctaattatcgagcaatcactgctgtctgtacttcaagtctgactgtcattaagagcgatttttcaaaggacatgcaaagcttgtcttttcgtcataacgtgaaagcacggcagcatggctggttcatgtttcattcaacgagcatcaaaaaaggtcttccaagaatggaaaaccgttgttcattcaatgtttagttgatttgacttaagcgttcagttagcagacagttttttaaccgccttagtggcaacttaactcatgaaatgatgccaactgtcaattttttggacgtcctcgggcaacgccaaaacttctggccgctcaataaattgttcgttcaccaaatagcgcaatggtttgagtaattggggcagtatcaattgatcaggttcatcgttgatgatagggatgaggtgatcgtgcatcgctggttcattcaccagctggacgaaaagctcgcttgaagcatcaatgtaaagtttgcgatcagtatggagaaaattctgcgtcaaccaccaaaccaaaatcgcattcatatccgtaaacatatgaacaggttcacctgcctgattgttgagccaatactgcttgatcaaaggcaacgcattgatgattggaacgccgccaatattgaaaatcgtcgcttgaatcgtcgtgttggtcagcactggctcaagaagtgaaatttgttggaagtcaggcagttgcgcataaagttcagaagcgaaaagtcgctgatcctcgtcataactatcctctcgagtcaattgacctgcatgaaaataactcatcatcgttacacgtttgcgatcatcatgcgcaatttttaatgcaattcgcccttcatcgtctaaatagcgatccgtccgactgccggctgctggcttgaccttgaactgttcaagcaaatgcgtgccaaaagcagcctgtgttcggttggcagcgccgcgatgatgcaggtcatcataaaaattatgatacgaagtctgcggtaaaaaaagcttcttcttatcccgatagctcatgaagcgcgatgtcgcatcaagttcaagatcgccggtgatgacgcttggtgaaagtgcctctttcttgaaaaggttcatcaccgaccgaatccttgcccacatttcatccggcatttctgtcgggagcatatccaagtataaataatccgttttgacatcatcaaacgagaaacctgccaaatcactttcctgtcgttgtcccggttcaacagcctgcttctttatgttaaagaaactcattgcttgatctccccctttttcctcgcgagcgtcatccaaccagcttgtaagcgaagccttatactgattctagattgacaaacgtgtggtagcgccgataagcagctattgtgcattcggtcactttcatctacggccaagtatgccatagcaaacaaaatttctgccactatttaggtcggtggagggccagtttgatcagcaatttttaagttaacttcaacaagaaatcccgcaaaaagcgcaatctatcttgcgctttgcgaaataaatcagtctgatactgagtcaacacttcttctctaaatgggcgctggtcaatgtattgatcgtatcgtagctcaatttgaatggcggtgatattaggttgatgaccgtagtagcgcgttatgtcaccgccacgaaatggaaagttattttcaactgtgaaatcatgtgcagcaaacgcggcggatagcgtttgtcgaaaaattttactagttgttcggtcatggtcattgcctaacacgattgtttttggcttgataccagggtaatgaggatattgggcaaaactatgcaagtcaattaagtaagcatggccaaattttgcctgtttttgctttaaaatcattgttagggcgtgacgatacggccaataataggttctcaaccgtgattgcagtgtttctggcggtagcggccgcgcgtatagaggatggttgaacgtatttcgctgataaattgtggcagaacgataatcgtgatctgaatctaaggtaacagcacgattgggatcggcgacatagcgattaacacgattgatcagcgtcgtgaagccggtttgcggcaggaagtcataaagcgcaggcaagaaccagtcgctattggccaacacggcagttggcaataaacgcttacgcatgtcagcagggatccaagtaccactgtgcgggaaactaatcacaacaggagatgctgcgtctgcatgcagcaactcaaaggtagctgatagttgttcgttttcacccattttctttcctcctcggtgactgttatcggatctagaacaggtacaggttgagacatacttctaagacgacaaagcaaaagcgaacaattttccatttggaaatttgttcgcttttgcctgctcatagataatttattatgattttaaggaccgtagtgccaaggcggagcaatcgtaggccagatggggctcagccgtgcaaacaacacagcgacggtttctggagctgatgtctttgggctcgaagcgccgtcacagcgttccagccccagctggccggagattgcggagtttggcacggcaaggaaattttagcctagcatcttcctacgattattcggaatttaatgaatcacaagttctatgagggtaagatggctcaccctcttccgcatacaggtgatttttaattacttctggtgtccttcttcaggcagcaagatagtttgactctcgccgtcgtcgtaagccatgactgtgtcgggaaaactgggatcatacgggaatggcagatcaactgacatctccgttgccgcgccattttcactaaaatgaacggtcagcttcccctgattattctgcagatcgaaacgtaacaagttatttagcggaacaaccccttgcagatttcgatcgatgatcatccaaatgctatcaatgatttcacctggcagattcgagatgacgccaaaagtcgcgaaccgactgtgatttgtctcaaacatacacgcgatctccttccttcagtcttgcgtggcaatatccgcaaattgtgcatcaacaaattgcgccaaaattttaggatcaatgccaactgagcgacccactttaccggcggaaacaatgatcgttgcctggccctcagcctcttgactgataaaaataggatacttatgccgttcgtgaatgccgatgggtgtgttagcaccatgctcgtaacctgtggttttcatgagatccttcagcggcaccatgcccactttgcggttaccagagaccttgcttagttttttataatcaacatgccgatcgagcggcacgacgccgaccaccggaccagttttgttgcccgtcaagaccagcgttttataaatctgatgttctggtacatccagatggtcaactgttagctgagcaacatcgcccacctcttcagtcggaaattcgtaaggcacataagcgatccccgctttgtccaacattttttcgaccaaggtcttttcaaccttattgtgatgtttagccatcgcgatcccccctaaacgcgatcacagtcgcagcaatctgcgtgtaagaacctcgagtgcgatgggcccaaacccggtcatcacgcctgaggctacttacacgccggtttctatgcgcgactgctcacgctcttgcttaaatgcgccaccttgcgtagccaacctacatgcatgtaaggaccttggtggcaatggtcaaaagacggcaatcacgcccaaggccgcttacacgccagccgctaaccgcactggctcacgctctgtcttacgttaatcccgatgccacttaaaatactagggcattttgactgaaaataccactatcatgcgccagtgtatgacatcagcgtgaacatgtcatagtctttgatcttgtcgcggccgtgcaagtcgcttagctcaatcaaaaaggcggtgccgacaacgatgccgccaagctgttcgaccaagcgaatcgtagcagcaatcgtgccgccagtggccaacagatcgtcgcaaactaggacacgttggccaggtttaatcgcatccttatgcaagtataaggtggcttcgccatattcaagatcgtagctggctttaacggttggccgtggcaacttcccttttttccgcgccggagcaaagccaatacccagcttgtacgccactggacagccaacaatgaatccgcgtgcttctgggccgacgatcatttcaacgcctttgtcctgtgcataagcagcaatttcatctgtcgctgcagcataggctttgccatctgccatcaaaggtgaaatatcacgaaaaataatccctggttcagggtaatcctgcacactggcaatgtaatctttaaagttgatggtcatgattctacctcactgtctgaatgctccgtcagcaacatggtttcaagctgagcgcgcggcatggtctgtaactgttgcgccagatctagaaaggctgtgcgcgctgcataagccttcgccgtttgcagcggctttttcgccggggctgtgactggagaaataaaagcaccctctattgtaacaaaatcgagttcaaaaaacacctgaaccgctaagatcacttgatggacggttaaatggaccgccttagcaatcgctggaatgtgatgcttgtcgaacccaggatgggccttcagaaaacgcaacacggccccaaattctgcccgcgtcggtatagcaaccaagcggcttggtgcgccgtaaaacatgacggcaacaggtggcagcacatactgcatcacctgatgcaacgcggcagcatcttttggcaagtcgactaaaactgcattcgctaaaggcgcttgaacctgagcagcgatggtcgttggcccaccaaaggaaaattgccgctcaaactgttgctttactttcgcatcaaaaaacacatacgtgcggctggctttgaactggccgccgtcaatcgttggcattcgccagtcaatgacttgcggctgtttgacttcatagtctttcaacatgagttgtagactggtatgaccttgccaagtgttttgatccagctgaactgccaatttaacggcctgtgccgttgccagtgtttccgcagcatcaccatagccaaaaccaatcacattgatgccttggtcaatttgaaaacgcaggtgattgttttctttaccaatctgtttcacattttggataacttgcgggcgtactgagaaaaccggttcgggattgccttgaccaaacggtgctaactgacggatcaattgatagtgatcaaatgtcaaatcagcatcttccagcctcgttgagataggcagcgttggtttcggaacagttttcagcattgttgccgcagccgcctccatctgcgcatgaatcgatggtaaatccgttgttttagctgtgagaccgactgccatatgatggccaccaaaatggaccatgtgttcctttgctggctctaaagctttgaaaagatgataagcctcgatcgagcgacctgagcctttggcagtttcgccatcatctgcaatgttcataattaacgttggcttgcctgttgcttcgacaaccttgctggccacaatcccgacaaccccttcatgccaacctttactggccagcaataatgttttggccgcttggttttccggcgcctgtgccatcgtcaaagcttcctgagcgatctttgcaactaatccttgtcgttcctggtttagcttgccgacttgttcggccaactcagccgctacgtcatcctcaaatgtcgtcagtaacgttacgccaggattcgcgtcgcccatccgcccaagtgcattcaaccgcggtccgatgacaaaaccgaccgttgtttcattcacggtttccggggcaacaccggcttcctttaaaatagccgcaagcccgacccgtggctgagtctggatcatttttaagcctaattgcgcaatcacgcgattttcatcggttaagctgaccagatcagcaatggtacccaaagctgccaagtcaacgctttctaacggtggttcgcctaataaggccgttgcaaccttaaaggcaacgccagccccagaaagatcaccgaacggataatcgccatctggatgccgtggatgaacaacggccaccgcatgcggcaactttgctggcaactcgtgatgatcggtcaccaccacatccatgcctgcagcctgtgccggattgatgactgcggcaccagcaacaccgttatcaacggtgattaccaactgtgtgccagttttttgcaaataagcataaacttcggcattcggcccataaccatcggtgaagcgatcaggaataaacacatccggatcggcgcccagactttgcaaggtctcaagcatgatggcactgctggtcaacccatcaacatcgtaatcgccataaatcgtgattttttcattttgctcaattgccttcaaaatccgggcaacggctttatccatgtcatgcaaggcgaatggatcatgcaatcgactagtgtctgggtgcacgaacgcatcataatctgcctgatcattaatcccgcgttgcagcaacaaggtcgctaaaaatggtgggacacccaatgtctcgctaagcgcgtgtgcatcagctgctgcaggttgtggggcgagttgccattgatactgcgtcatatcgtctcgttcctttctaaccgatccagtataccagagaaagcttggtgaattaaccggtatgcctaagttatctttggcagatgctgactgacaggacacaaacagaatgcgtgtcggcatgacatgttattgtgtcggacattcaatgcaagccatccgtgcgactcattgaaaacgtgatataattaaattgtgaataagcccaactccagtcagcgacttaagatgtgtgatcagcttaagttggtcatgcgataaggaggaagcaccatggcaaaatctcaagaccaattcaatgaaaaggtcggtaaagaaattaacgtttctgacgaggccgtcgataaagcagctgcccaaatcgagaaagtcggttacgtcactgaaaaggacgttccggaaatgatcgatcgcgattacactcgggcattgtccaagaaggtttcggcaaaacttcacaaagacaatgacgatgattacttctacgaagagccttttgactatgaaaatggccgcattgcaaatatcatgtgggacatggataaaattaagacccgcgaagaagccatgaaaattttggctgatgaacttggccttaccgttcctaagattgtaatgcgtaaaatcgacgaacaggtcttctagtctggaggagtttcacagcttcagtttctgcagctgtggacgcggttcaactttaataaaacaaccggtatcctttgcggagccggtttttttgtgagcgcgaacaaaccacacttaaaaaacggcgcgtaagtggtcttaaggcaaacggtcaaaaccgtggccttaattttcacatgtaagccttctgcaattgcgagcacgttatggcgataatcggcaacatcaggatagcagctagtgacagggatttttcaaacacatcatcatgcaaccgccagcttattgtgtgataatgatgataaagaaaggatgtgaatgccatggctgaccaacaggaattagatgatttttttgcccacgccaaggctgctctagatttgcacgctgacacctatgaagatgcttaccaactcggcggtgcaaaatttgctgataaactcgctgcattggttaaaaccggcaagaaaaccgcaacttcaagcggctttgagctgtatactattgaacaggatccgctacccaacgccggcgtctataatattatcttgaatcgggcggataagcctgttgccttgactttcacggacaatgtttttgtaacgccatttatgaaagtgactgccgatattgctaaacgcgaaggagaagacgatcaatccttagctagttggcgtgaagtccatcaagcctttttcagtcaggaatatcaagcgaatggcattcaatttgatccagaatcatccatggtcgtggtcgaggaatttcatactgtgtacccagtcgttcaaacgaggtgaaagcaatgaatctcaagcatcgtacagcgatcacagaaaagaaagtcacgcaaaagctcgatgacatcccccatcccacacttgatgccacactctacttactcgttttcagcatcactgctatcggcggcctagtttcctatggcgcctatcagctctttaaaccggagcgaaagttagcccacaaagcaaaaacactcgttgatgaacatgaagatgaccaccaacacaaggcataaaaaaagcaggtcacaacggcctgctttttgcttgttttgaagaagatgtgggcaaatcaccaaggtctttgtttctatgaaaacagaactgcctatttaccttggctttcttcatcattcatcttcagaatactcataaacgcttcttgtggaacttccacagaccccactgatttcattcgcttcttaccagccttttgcttctctaaaagcttccgtttccgcgtgatgtcgccgccataacattttgcaagaacgtttttacggtaagccttcacagtgcttctggcaatgactttattgccaatcgcagcctgaatcggaatttcaaactgttgacgcggtatcgtggttttcagacgcgcaacaatggccttgccgcgttcgtaagcaaagtccttgtgcacgatggtactgagcgcatcgacaggatcgccattgagcaagatgtccatcttaaccagatcactttggcgatagccggtgatttcatagtccagactggcgtatcccttcgtgctgctcttgagatcatcgaagaagtcgtaaatgatttctgaaagcggcaagttgtaaatcacattcacccgatacttgtctaaataatccatcgtcacaaactcgccgcgcttacgttgcgataactccatgactggcccgacataatcattaggcaccatgattgaggctttgacatacggttcgcgaatttctttgatttcgctaacttctggcatgtcagctgggttgtcgatcgttttttcagtgccatcggtcatgatgatttcataatccacacttggcgcggtcatgatcaagtcaaggtcgtaatcgcgttctagtcgctcttggacgacatccatatgcagcaaacctaagaacccgcatcggaagccaaaaccaagcgcctgcgaagtttctggttcaaattccaaagccgcatcgttcaactgcagcttttcgagcgcctcgcgcaaatcgttaaacttggcattatcaactgggaaaaggcctgaatacaccattggcgtgattttgcgatagcctttcagcggcttttctgctggccgatccgctaaggtcaccgtatcacccacacgagtatcctgaatggttttgatcgcggctgtgatatagccaacatctccgaccatcagaaaatcacgtttgaccgctttaggcgacatcacgccgacttcggtcacttgaaattgcttgccattgctcatcagctgaatggtgtcgccgactttaacttggccttccttgacgcgcacatcaagcacaacgccacggtaatcgtcataaaccgagtcaaaaatcagtgcttgtaatggcgcattcaaatcgccagatggtgctggcacatcggtcacaatccgctcaagaatttcaggcacgcctaggccggttttaccactggccaaaatagcatcggaggcatccagcccgatcatctcttcaatttcctctttaacgacatctggctgggcactcggtaaatcaaccttgttaatgaccgggatgatttcaaggtcatcatcgatcgctaaatagacgttggctaatgtctgggcttcgacgccttgggtggcatccacgaccagcaaggccccttcacaggccgccagactgcggctgacttcatagctgaagtcaacatgtcccggtgtgtcaattagatgaaaaatataagtttcgccatttttagctttgtaatgcagttcaaccgcatttagtttaatggtaatgccacgttcacgttcaagtgccatatcgtctagcacctgcgcctgcatatcacgtttggcaatggtatcggtcaactccaaaatacgatcagcaagggtcgacttcccgtgatcaatgtgggcgatgatcgaaaaattgcggatatgcttttggcggtccagcatttcttcttgattcatgtttagtagtgcctactttctaagcgaatgtgatatgagttctattatagcagagcttgacgctgctcggtagaaacggcagtagcgcgtgaacaagccaagatagaaatcggaaccataagcagccttctcagccgaataatgttggcatgacactcaaatgccatcgaagacaaagaaatcggacggctcgtttgccttatagtgggctatctcgcttcggcgaacatcttgccaaacagtttcgtggtgcttcatcccaagctgatgataaagcgtcagcgtttggtcaaataaggtagctgcttcagattctgcaccttcgaacaacttaagccagcccgccataaatggcaggaaaattgagatgtcagctaactcagcttttttcgcttctctttgagccaagtttagacattgagctgcctctgcaaaatgtgtttgggtaatgtaggctgtggtagcggtgaaatagacataaaacagctcgcgttgataacccggaatggcggccaaaagagccgacttgcgtttaacattgtcgatgaattgacggttgactgccaaaggaaaaagccgcgcactttgcttaaacaagcgcatttcatgcaacccccattgatcaacattttgtaaataataggcaatccctgacaagtacgggggatgtccgaaatgcgcatagccatggcgaatttgcaaaaaatgatccagttgaagactgtaacgtttttcattttgacgctcaagcatggttaagcgctggtcaatggcctcatgatcataaggatgcgacagtcgatcatagctgtagcgaataaggttcaagtaagcttcaatttgctgttcagagaccgacttggcggtgccggttcggattacttggaactcatcaaaactgacagcaatgcggtctagcaaatgaataaaccgctcagtcgaaatatgcagctgatcatgctcaaactgtgagatcaacgaaatagaattaacgtcatccgccacttgttttagcgttaatcctttactgcgtcgcaaacttcgaaaagtcgccccatactgcatatgacatcaccgcctcaactttttagcatactgaaattatagcaccgacacatgtcatcctcggtaccttattcattaagaggtgatcccgatgacattttttcaggaattattacggcttaaatggcggctggtgacctatattggcctatacggattgatgaccagtgccttaactgcgacagccatattgagcgggaatgcgatgacagcactcacgcattttcatcgcaccatgtttattgaggcggcacttttgctggttatggtgacaatcacccagcttgccttagcaacgttgaccaatattgaccaattcgtcctccagcgccatctcaacaacaatattcgccgtcaactcgtcgccaatatcgctaaaatgtcctatctgacttatcatcgtcgcacggatgccgtttatacttcgtggctcaccaacgatatgaacacgatcaatcagcagggactgcgatatttttcttacatgattcaagctatctggcaggttctgcttagtgcgatcgtcttggtgaattatcaaattagttttttaccgactgttacattggcagctactgccctgttgatagtaccgctgctctatcgcaaacgactggcccgggccgctgccgaatttagccatcaaaacgagcggttgaacaagaaaatcagcgatgttttggcaggattcgacaccttgttgatggctaatcgccaaacgttgctgataaaccgaatcactcacgcttctgatgaaaccggtcaggcaaatcttcactatatgcaatttgacatgttcacgcaatttctcattaacctagtcaatttggcaagccaactggcgcttttgatccaggcaggtctattggcttaccaacaccaactggcagttggtgccgtcgtaacaatttacagtcttggcggttcaaccttcagtggcttaacgttgctgagcttctccttaacgaccctcaagtcagtcaagccgatttttaaaaagtttggggcggctgcaattaccttaccgagtactggacaaaagatcgggccactagcgcacgctttgaagatcaagcagcttgattttacttatggcaattgccgtgaaccaatcctccggcaacttaatctcactatttccgcattaacaaaaatagccgttgtcggtgcctctggtcgtggtaaaacgaccttagtcaaactattgaccggtttgttgcagccaactcacggcggtatttattgggatcagatgccttatcccgagattgatggtggttctttacgcaatcaaattacttacattgatcaatcaccatacctttttaatgcaagcatccggttcaatatcacattaggcgatccttttactgatcgccagctcaatcaagtcttaacgctgtgtcagttaacgaccttcgtcgcaaatcagccacacggcctggagaccatcctcagtcagaatggtagcaatatttctggcggtcaaaaacaacgactggttttagcccgcggcttgattcgcaaccggcgtttggttatcacagatgaaagcacagctgccttggacgaacccacggccatcaaaattgagcaactgctcgtcacattgccaaatatcactttgatcatgatcacacatcatctgcattcacaaatcgctaaacaagtggatcggatcatcaaactgtgatgatggcttgtctccaccaaataatctaagattagttcctgtaaaggatgtcggtttccaactccttaccggatttttcttttctcccgttacactgtaaaattgggatattattcacaaccagcaaaaaggccaacaatttccaaagcggaattgttagcctttttctcatggataatttttattgggatttaaagatcccagtgccaaggcggagcaatcgtaggccagatggggctcagccgtgcaaacaacacagcgaccgggctttgtcgctgatgttgttaggcgacttcgagaccggtttttgggctcgaagcgccgtcaccgctctagcttcgcgtcgccaccccatctggccggagattgcggagtttggcacggcaagaaagtctttgcctagcaccgcaccctatttgcttacttaccgcctttaaaagcttccttaacccgatcgaacagcgtgccattgtgcggggtgacatcctcgccactagcggctgcgaactgcattaaggctgacttttgcttctcattcaaatgctttggcgtctgcacttcaacggtgacaatctgatcaccagtaccattgcctcgtaagcgtggtgcccctttgccgcgaagtctgaacttcgtctggctttgggtgccagcaggaattttcaattcaactgcaccatgaacggtgtcgactttgatctcgtcacctaaagctgcctgagcaaaactcaacggaatggtcagatagatttctgaaccgtcacgttgatactttttgcttggtgcgactcggaaaacaatatagagatcaccataagggccgccgttggttccagcttcaccagcctgctgtagtcgcatttgctggccatcttcaacaccagccggtactttcacatcgatggtgtgacgttcctgttcgtggccagtgccatgacaagtcgggcacttttccttgatttcctgacctgtgccgccgcaaacatcgcagacctgccgcgtcatcatcgcgccaaatgcggtgttgcgttgaacctgaatatacccactaccgtgacacttatgacaggtcactggactggtaccaggtttagcgccgctgccattgcaggtgtgacaaacggcttcacgatcataggaaattttggtgtctttaccaaaaatagcttcctcaaacgttagatccatgcggtattgcaaatcggccccttggcgcggtgcggatggattagcttgcgcaccaccgccggcaccgccaaagaattgactgaagatatcgtcaaatccgccaaaaccgccttgtccgccgccaaagtcactaaatccgccttgaccagcaccagcgccgccaaacccttgcggaccgtcagcagaaccatactggtcataggccgcccgtttttggggatcagacaaaacctgataggcttcattaatgtctttgaacttctgctcagcccctggtgcatggttgagatccggatggtatttcttcgaaagcttgcggaacgctttacgaatggtgtcatcatcggcatctcggcttacaccgagtgtctcataataatctttctgatccgccatagttcctcctcgattcagatcatgactgaaaatgcctgttcagcatagcataattcaaacaaaaagccaaaaccgcgccgcggcttcggcttcttgctcatgatacaacatgttacttcttatcgtcgtcggaaacatccttgtagtcaccattaatggtgtcatcgtcagactttttatcatcgctgccttgagctgcgcctgcatcagttgctgcaccgctggctgggccgccttgcgcctgctgattcttctgggcattttcgtacaacttcacggtcatatcctgaaccagtttgttcaagtcatcccgtttttgcttcatgtcgtccaagttgttttcttgttgagccttcttcaaggcttcctgagcatccttgaccttcttgatgtcttcttcaggtaccttaccgtcaacatctttcaatgtcttatcggtttggaagagcagctgatcgacgtcattctttaagtcgacttcttctttacgcttttcgtcggcatcggcgttttcttcggcttccttcttcatccgttcaatttcttcatcggacaaaccgctagaactcttgatggtgatgttttgcgacttgccggtgccaagatccttcgcagaaacctgaacaatgccgttcttatcaatatcgaatttaacttcgatctgaggtacgccacgtggtgctggcggaatatccgtcaactcgaagcgaccaagtgtcttatcgtcagctgccattggccgttccccttgaagtacgtggatatcaacggctggttgactatctgctgcagtagagaagacttgactctttgaggttggaattgtggtattacgatcaatcagtttggtgaagacaccgcccatggtttcaatcccaagagacagcggcgttacatccaacagcacaacatccttgacatcaccagagatgaccccgccttgaatggcagcaccaagcgcaaccgcttcgtctgggttaatgctgtggtctgggtccttgccagtccactgtttaactgcttcctgaactgctggtgtccgagttgaaccaccatttaaaataaccttgtcgatgtcagcgttggtcaacttggcatccttcaaagcattttcgactgggatcttggtcttggcaaccaggtcagcggtcatttcgtcaaactgtgcccgcgtcaaggtgcgttccaaatgcaacgggccattagggccagcagagataaatggcaagctgatctgtgtctgggtaaccccggacagatccttcttagccttttcagcggcatccttcagccgttgcatcgccattttatccttggacaaatcaatgttgttgtctttcttaaattcagcaactagccagtcgatgatcttgttatcaaaatcatcaccgcccaaatgggtatcaccattggtcgacagcacttcaaagaccccgtcgcctaattgcagaatggaaacatcaaatgtcccaccgccaaggtcataaaccagaatcttttcgtccttgtcgcctttgtccaagccataagccaaggcagaagcggttggttcgttgataatccgctgaacattcaaaccagcaatcttgccggcatccttggtggcctgccgttggctatcattaaagtaagccggtacggtgataacggcgtccttaactggttcgccaagataatcttcagagaacttcttgatgtattgcaaaatcatcgcagaaatttcctgaggggtgtattccttatcgccaaccttgactttgtagttagcttcacccatatggcgcttaatggaaacaatcgtgtctgggttagtgatcgcttggcgcttggccacttcaccgacttggatttcaccatctttaaatgcaacaacagatggcgtggtccgattgccttcagggttggtgataatttttggctgattgccttccagaaccgcaacagctgagttggtagtccctaaatcaataccaataactttactcatagtttataccttctttattttcagattaattattttgcaacgacaaccatagcaggacgcaacacgcgatccttgaggtaataccccttttgcaatacctgcgcgactgtgtcagctggatgttgatcatccgccgcgaccgtttgaacggcttgctgggtattgggatcgaacttgtccccggcaccatcaatggcagtgataccgttttccttcaaagcgcgttccagatgatcgtaaaccatttgaacacccttcttcagggaaactgcactgtcatctttggcctcggttgcaagcgcccgttcgagattatcaacaactggcaaaatggctttagccaacttttgcccatcatatttcaacagcttttgctgctctttctcgaagcgagcattcatattttgaatttctgcagcggcacgcaggtatttatcttcaaagtcgtcgcgttcttgcttcaactgctcgccgtcatgtttactgttcgaaagttgttcgttaagatccgcgatactttcttgtaaaatatcttcttttaacgaagtctctttcgtatcagcagacttttcagctttctttgcggcgtttgctgcatgctttgctttttgttctgccatggtatcctcctttaacgcgtttcctgacgtaaaagcctgtccataagaaacacatgcacaatgcccaaaaaagaccattgcatttgtgcgccgatttctgaacgtgtcagttcacgctattctttaaacgcatcagttggcttaaaaacaccaactgatgctatttgctaacatgattattgatcaaagttggcatagtagtctgtcaaccgtttagctagctcttcgcgaaaaacgtcgagcaagccgatcatcttggagtacggcatttgcgtcggtcccaagagggcgatcataccggtaccgtgaccaccaacatcataactagcagtgatcaagctgaggttcgctagatcaataggttttaactctggacccagtcgcacttgaaccggtgtttggcggatcgggccgcccagcaactcagtcagatcgccgtgatccgcatcgatcaacgacatgatctttttcagctcgtgaatatccgaatcgccaaggtaatccatcaagttcaaccgcccaccaacataaaaacgttcagaggcagctgactttaagacattgccaaaaatatcaaggaagccgtctgggctggtcaaatactgcattagcatggacgggacatccgtcctcagccgctgtgctacctgaaccaatggcaacccgaccagctgatcattcacaattctgatggctttttcaagttcatcggaagaaatggacggcgggacggtgaacacctgattttcgacattaccattattcgtgaccaaaatggccatgacttgatggttacctagtggtacgagtcggaacccagtgagcttaatattgttgacttccggaccgagactaatggcggtgtagctcgtcagatttgatagaatctgcgcgctttgtgccacaatttcgtccattttgctgtaacgctggccaagctcctgcttgatcgttgccaaatcatggcgagagacgcgcacgggttcaacaagatgatcaagatagtagcgatagccttgtgtcgaaggaactcgacctgaactgctatgggtcttggtgatcagaccggcatcttccagcgctgccatgtcgttgcggatcgtcgcagaactgacgtgaaccggcagctcttgcattaacgtctttgagcccaccggctggccactttcagtaaacaaccggatgatctcttttaagacgagcaattgccgtttcgtcaacattttctcacctcacctttagcactcgttttatatgagtgctaatacaatgaataatataccaagcgaggttagcaaagtcaaggtacgattgctagattgtgaacgtttctagtgaaaattatggcaagtgcattttaacaacacagccgtttcttttagcacttaaacaagcggctcatcaatcaagaaacgttgaaaaacttcgttgccaaggaacttgcctttgttggtcaggcgaatgtagccatcttggcgcacaaccaaaccttgactgaccagttccggcacagtttcaccataaatggcgtcaactgtcatgtggtagcgatcataaaaccgcgcttcactgaccccctgcatcgtccgcaagcctagaaacatttcttcttcgatctgttctgactgtggcaccaaatgatgttcaaggaccggcaagtggtcagcatgtaatggtgttaaatactgcttaataggaccatagttgtggtagcgatcacgaccaagatacccaaacgcaccagcaccgaagccaaagtacttgtcattacgccaataaagcaagttatgctcacactggtacccgtcttttgcaaaattactaatttcatattgatgtcggccatgtgcttccatgagatcgatcgcatcttgatacatatcggcctcgacgtcttgggtcggcaagcgcaacttgccctgtcgcatcagattatagaagatcgttttacgttccaaaattagggaatacgttgagtaatgcggcagatccagtgccaacgccttttgcaaactggtcagaaagtcatcgcggctttgatcaggtagtcgaaaaatcaaatcaatcgaaatattatcaaacccgacttgacgggcgttagcaatggcagtgtaaacatcttttgctcgatgtatccggccaattcggcgtaatacatcatcattaaacgattgcacgccaatcgacaaacggttgacaccataatcatgtagcacttgcaacttttcggtcgtgagcaagtcattggggttggcttcaaaagtaaactccccttgatcaaaatgtaggatatcgtgaataccctgacacaatgtagccaattgtgtcggtgtcagcgtgctgggcgtgccaccaccgacataaaccgtctgaattttttcttcaggatgttcggccatcaccatccgcatttcttttagcagcatggccacataatcatcaactggctggccttcgatgaaaactttgttgaaatcgcagtagtaacaaatatgttcacaaaatggtatatgaagataagcacctgccatattaacccttctttgcggcaaaatagtctcggacggcagtttcatcttttttcaattgatcaatcagggcatcagcaccagcaaatttcacttcaccgcgtaaatagtgataccagcgaacttgaacgttttcgccataaatcatttgatcaaaatcaagtaaattaatctcaagtgtcacgtctcgatcgtcgccaaacgtgacattacggccaatggaggccatgcctaaataccaagtggtgccaactttgaccttcactgcataaataccaatgcctggtaatcgctgttggccaagtgtctccaaattgattgttgggaagccaagcaaacggccacgcgcctcaccatgaaccaccttaccagcagttgtataggtataacccagaaaatcattggccgtatcaatatcactggaatcaagtgcatgccggattcgggttgaactgaccttttgaccatcctcagcgagttcgggcacgctgatgacatcaaaccggccacgagcatattttggcaataaagccatagatgcaacatcccgcttgccataagtatagtcaaaacctgcaactaccgtatccgccttcagaccgaccaaatactgatcgacaaaagcttgcggcgtcagcgcagcgaagtctggggtaaagtgaaccacatacaaatagtccacgcccagtgactgcataattttgattttctcttcacgagtggataaataccgaatatcggtttcggaaaccccacgataaacgacggctggatgaatattgaacgtcatcaccgccaacggtatcttttttgctaaagcgatcttcttgccggttttaatcaccgcttgatggccgcgatggacgccgtcaaagaagcccaaggtcaagacgatgggctgtggcggggccgcggacacctgcaatggcggctgaatatcaattgttttcataaattttcacacattcttttcattagctaaaaacattaaatctggccgatactgatcgtcttctcggcgatagatagccttaagaacgcctgcaaaatgcagacgaacgcgcggagtctgctgatcgagcgataaaaagcggccatgactgattgcctcaaattgttctacggtcaaatcaacttgaggcagatcggcaaaagcaatatcaatcggttgaatcacatcggctaaagtacctgccgcggcatgagccttcaattgctcaatgctaaccgcctgcttcaacgtaaacccgccgctttttactcgcgtcaattgactcatcaccgcagcaactcccagcgttttgccaacatccactgctagtgttctaatgtaagttcctttagaaacatggacctcaaaccgaaaccgctgggtgccatcagtggctgaaaaaaccggttcatcggtacgtgtaaactgtgacaccgtggcctgtcgttctggccgcttcacagtttcaccggcgcgcgcatattcgtaaagccggcgaccgttgactttgaccgccgaaaacatcggcggaatctgtgtgatgtttcctgtccacgcagtcaatgcagcatccaactgatcagctgtaaacggctgcgttaaaggcgttttatcaacaacttccccatccaaatcctcggttgtcgtcgcaaaacctaacgtgatttctccggtgtagactttcccactggccattaattgcggcaccgctttagtgcctgcaccaatcgccagcggcagcacgccgtccacattaggatcaagggtgccggaatggccaatttttttgataccaagaatcttgcgggcatgatacaccgcatcagcactggtcatgccagtgggtttatataacggcaaaatcccgttcatagcagttcctttcatggttttgattttttatacatactatgatgatgtttttcatgctcgacatgtcgccagccggcccagatgaaaacaagcaccactaggaccgaaaaaagccagtctggcgttttcacatcaatcattggcagactgagacctaacttaatggcaatgagacctacaagaatataagctgcggtttcaagttccggaacacgatcaataaaggtggtgatgacctgcgccaccagccgcatagcaaagataccgagacaaccgccaatcaaaacaatcaccggattgctggacactgccaaggccgccaaaattgaatcaaccgaaaatacgatatcgagactctcaatttgaatgactgtcccccaaagcccgtgaggtcgtttcccatgcgtccctctctgattttttggatggcgcacttcataaaaataactcgcactcatccagacaagatacgccgcaccaatcgctttgatcggccagaattgcaataagtaagtacctagtccgatagcaatgaagcggaatatgtatgcaccacccataccgtacatcagagctttttttcgttctgattcgaccttgagctgctcggtttgtgcagcgagcacgacagcgttgtcgactgatagcatgcattctagcaagatcaagctgaaaatggtcacgaggccgctaacagaaaatgccagttgccaattatgcgctgagaagaatggtccgtataaggcacctagtaacttgatcgtgatccttcctttctcaatgattattattataccgtgcaagcttgaaaacctaaagctgttgggcggtaaagtctgaaggtttgaattgatggttctattacggtttagattcaaaagattgtctaggggatatgaggtaagaaccacaaatctatttttgcaccgcgactttggactgtctctgtaaggctccttgaacaccgcagctacgagccggctccgcggcgattcggggtggcgaccgcgaagatagagtggtgggcacgacttcaagcctgcaaaaaccgcggtcttggaactcggccttggtctaagcggagaaaaccactccgctaagaccaatgtcaccactgagcccatcgccgctccgccggctctccgcattcgatttcaaaattcaaaccggatacacaatcctcctattgctgacacagtatcagttatcgattataaaaaagacctgaccactagcagcagtcagatccttcttttaagtggtgcttattcaagattcttccgtcgtacttcattgatcagttgatcaatgcgtgcgccgtattgaacggatttgtcttgggcaaactcgatttccggaactttaaataaccggatacgctgcccgacttcgcggcgaatgagtccactggccttgtccagaccggtttgggctgcttcgactttgtcaggcgcatcatcgagaatgctgtagaaaatggtggcatgttgcagatcaccggtcagtttgactccggtaatcgtcacgcctttaacccgcggatcgttgacatctttcaacaagatatcgtcaacttcacgttggatctgagtctcaactcgaccgatacgatgtttcatatctgcctacctccttcaaaacagtcggtatcattaaatcctgagatacgtttgggttagttacttcactggaacctgttccattgtgaaggcttcaatttgatcatcgactttaatgtcgttgtagttctcaatggtcaggccaagttcaaagccttgacggacttccttgacatcgtctttaaagcgacgcagggagccgagtttaccttcgtacttgacgatgccatcgcgaacgagacggacaccagcgtcgcgggtaatatagccggaatcgacataaccaccgacaacggtaccaaccttagaaaccggaattgtttcgcgaacagtcactgttccgatcaccttttcttcataggttggttccagcatccccttcatcgcagcttcgacttcttcgatcgccttgtaaatgacactatgcaaccgaatatcaacatcgtcttgttctgcttgggcttttgccagcgcagttgggcgaacgttaaagccaatgatgatcgcgttacttgcagctgcaagggtaacgtcactttcgttaatcgcgccaacggcctgatgaataatattcacccgaacacccttaacttcgattttctcaagactgccagccaaggcttcaactgagccttgcacatcggccttgatgatgacgtcaacttctttcagctgaccttccttcattgtttcaaaaagattatctaacgtgacatggttggtgttcttacgttcttcttcctgtgcccgcttggctcgttcttcaccagcagcacgcgcggtgcgttcatcggcaaagacaacaaacttgtcagccgattgtggcacatcgttgataccagtgatttcaacaggcattgatggcaaagcatctttgacccgccggccatgatcattagtcatggcacggacgcggccgaaagtattcccgacaacgattggatcacctgtatgcagcgtaccttgttgaaccagtacggtagcaacaggacccttacccttatccaaacgtgcttcgatcacagtaccaaccgctttttgatcagggttagctttgagttcgagcacatcggcttcaagtaaaatcatttccaacaattcatcgatgttcttgccaaatttagctgagattttgacgaaaatcgtgtcgccgccccagtcttcaggaatcaacccatattccgtcaattgttccatgacgtggtctgggttagcgcctggcttatcgatcttgttaactgcaacgatgatcggtgccttggctgcctgcgcatgatgaatcgcttcaatcgtctgcggcatcacaccatcatcagcggcaaccaccagcacaacaatgtcggtgatgtccgcaccacgcgcccgcatgttagtgaaggccgcatgcccaggtgtatccaagaacgtaattaaccgatcacgcagtttaacttgataagcaccgatatgctgggtaatcccaccggcttcgccttcagtcacatgtgtgtgacgcagcttatcgagcaaggttgtcttcccatgatcaacgtgacccatgatagtaacaactggcggccgtggctgtaagttgtcttggttcttgttttcttcttcgaacactttgtccaagtcggaaatatcttcgtgaaccttttcttgggcgtcaatcccgtaatcggtagccaacaattcgatggtatctttgtcaaggctttggttttggttaaccatcacacccaacatgaagagcttcttaatcaattcagctggttcgcgatgcaaaatcttaccaagatcctgcgcattcatcccaacttcataaatcagtgtttctggtaatggccgctctttacgctgcggcatttccttcttcggtgcgctttgttgacggcgcttgttcttcttgttgcgccggttgttgcggttaaacccgttacgattcccataactgttgctgcggccaaaattactgttcccgccgccacgccggctattgcgattgtcttggctgccggcacttgccggttttggtgctgccgccgctggaactggagccggtttcgtaaagcgttgattggttgttgcagctggctgctcagtgcgcggccgttccgtccgaggttgctcagaacgtttactcgctgcatttgccggtttgaccgcttcctgacgttttggctgctgacgttcagacgctggtttaacaaacttgccaccgttgcctgccacaggacggggattgccattagctgccgtgggacggccagcacgcggcattggccctgtgacgcgctggttatcgaaccgacgattgcggtcattacggttacgttcgttagaccgattattgttaccggaacgattagcattgttcgcagaacggttgttattattattgtttgagcgatttgaattccggccattagccgtattgttagcgctggctgtattgccgccacgattgtgattcgtgttggtatgcgccgtttgtgtgctgcgtggtcgcaaaattgttgacttgctcaagatgattttgccgtcagaggtcttatttgaccgcgccggcttgttttcttgcttagcaacaggttttgcgtttttttgcgaatgctcagcagcatcagcatgatcgtttgacttggcactggcagcgactggcttcttagcagcctctttgtgtgccgctgaactcgccttggctgctttagcaggtgtctttgctgcctgtgatgacggtgctttgccagctgactgcttgcttaacatacctttgatcttagcttcctgatcttgatcgatcgaggacatgtgattttttacttcgatacccaagttcttcgcgatatcgatgacgtctttattatcgacgtgcatttctttggcaaattcataaacgcgttttttgcccatttcttcacgctccctgcaatttaggtgagcagctgttgcatcttcttagcgaagcccgcatccacaacggcaatgatcgagcgatcactgccgatggcctgcgatagttccattttggaaaactctgtaaccaaaggaacttcataatagctgcttttatccgaaaacttcttgcgggtgttggcactagcatcattggcaacataaaccaatttagcttcacgcgagcgaatcgctcctaagaccagattatctccggtgactaagcgactggcgcggcgggccaaacccaataaattcaatacggcttgtttttgcatcgtcacttgccgaatagttcttgacgagccttttgatgatcgacatacgcgaacaggtcatcataaaaggttggttcaatcgtgattccaaatgctgcgtcaatcagctttttaccctttgctgctttcacagcggctggatcaagtgccacataggcaccgcgaccagcagctttgccggtaggatcgatggcgacaacattttctttgttcttcacgatgcgaaccagttcttttttcggcatcatctgattgcttagcaagtccttgcgcattggaatcttacgctttttcatggctcgcctccttaagcttgcgccggatgatcggttgcactcggcgttacaggcgcttgatcagctgaatctggtgcatctgcggcggttttggcgtcgtcggcatcatctgctgcagcggcatcactgtcaggcgttgtctcagcgtcagttgctgcatctgcgttgtcgttagtttcagcagccgcttcagcctctgcttcaggcaattcatcatcatcaacgaattcaacttcagattcaggcttgatgtcaatcttatagccggtcagcttggcagcaagtcgcgcattttgtcccttcttaccaattgccaaggacaactggtaatccggcacaatcacagtagcggaacgatcattggcctcatcattgaattgaaccgcgataacctgagccggattcaaagcgttggcaatgtaatccgctgggtcttcctcccattgcacaacatccatgttctcacctgaaagctcgttaacgacggcttgaacgcgcgcaccacgcggaccaacagtcgtgccgacagcatcaacagcgtcattggttgatcgcacagcgattttagtccgatcgcctgcttcacgagcaatgttgacaatttctaccgtgccgtcaaaaatttctggcacttcctgttcaaacaaccgcttaaccagacccggatgtgttcgactaacgaaaacttgcggacccttgctcgtgttttcaaccttggtcacataaaccttgatgcgatcatgggcttcatacttctcgttaggcatctgatcttgacggcctaagaccgcttcgattttacccaagttgacgtagatgaaccgattatctcggcgttcaacgaccccttgaagaatctcatcttcatactgtgaatattcgtcataaacaatactgcgctcagcttcacgaacccgctgcataataacctgcttagcagtttgtgcagcgatgcgcccgaagtcttttggtgtgacctcaaatttgatttggtcaccgatttcataagccttgttaatcgccagcgcttctttcaagctgacttccagccgtgaatcgaaaacttcgtcagtaacttccttcaccgcataaatgtgaatgtcaccttgcttaggatcaaattcgacgtccacattttgcgcttggttgtaattgcgcttgtaagcagaaaccaaagcggcttccaaagcttcaatcacgacctcttttttgacacccttttcttgctcaagagcgtcaagtgcttggatcatttcctttgacatgcttttcttacctccactagaactcgatcgccaaccgcgctgaagcgatcaactgccggtcaatgacctgatcgaacttgcggctcttatctttgaccgtcaatgtcaactggtcaggcaatagctcctttaaagtcccttcaaaaaccttcttgccgtccagtttcttgaataaagagacatggatatagtcgccaactgcttgttcataatcagtttcatgtttcaagggccgttctgcaccaggacttgaaacctcaaggaaatattgctgcgggattggatcgggatccatggcatctagcttttctgacaaggcttcactgaccatcacacattcgtccagtgtaatgccgcctgtcttgtcaatatacacgcgcaggtaccacccgccgccttccttcacaaactcgacatccgtgaggtaaaaatgatggtcgtccaaaatcggtttgaccaaagcggtcacggtttcaacaaccgattgcgtactcaagccaccgcctcctttactttctcattcaagactaacacttctgacgtctccagatgcgaacatggtgacgttcgccaataaaaagagtgagcatcgctgctcactcaccgccagaaccttacattactattgatacaataccatagattgtgactacttgcaaactagcagacctttgtgctagtaagcctgtaagccaattcatcgcattttttctaaacattcatgacagtttgcatgaaaccgcattaagcctagaataaaccgtcaaatagcgataattggttttcgtctggcaagtcatccaagacatggtttgttgtcatataatcaatcaacgttttcgaaaccttaccacgattagccagatcttccttggacaggaatggtttttcttcacgagcggccacgatttgcttggcaacgttatcgcccaggcccggaacagcccggaatggtgccagaatcgtgtgatcatcctgaatcaagaaattgtgcgaatccgacttcgtgacatcaatcattttaatcttaaagccgcgttcgagacattcattggcgatttccaaaaccgtcaacaactgcttttccttggtagaggcatccatgcccttatcggtaatctccttcatggccgctttgactgcttccttgccatgactcatggcggcaagatcaaagtcttcagctcgaaccgagaaatatgccgtgtaatagatcaacgggtaatggaccttgaaccaagcaattcgtaacgccattaagatataggcggtcgcatgtgctttcggaaacatgtacttgatctttaagcaggactcgatataccaatcaggcacgttctcgttttcacgcattgccttttgccaatcatctggaataccgcgacctttacgcacatgttccatgatgttaaaggccattgaatcttccatgccccagtgaatcaagtccatcataatgttgtcacgacaaccaatgacttctttaagcgtgacaatgccttgcttaatcagttcttcagcgttacctaaccaaacatcggtcccgtgagacaaaccggaaatctgtaacagttcgctgaaagttgttggcttggtttcctcaagcattccgcgaacaaaacgcgtcccaaattccggaatgcctaacgtccccattttcgagttaatctgttccggcgtgacacccagactcttggtaccagaaaaaagagccatgacgccaggatcgtccgttggaattgattttggctcaaccccggacaaatcttgcagcatccggatcatcgtcgggtcatcatgccccagcacgtccattttcaaaatattgtcatggatggaatggaaatcaaagtgcgtggtcatccaggcagcattttgatcatcagctgggtactgaatcggtgtgaaatcataaatatccatgtcagcgggcacgatcaaaatacctgccgggtgttgcccagtggtacgtttaacccccgtgtcaccttgcgccagccgatcaatctcggcaccgcgcagttgctgtcccgtgtcacgttcatatgctttaacataaccatacgccgttttgtctgcaaccgtgccaatggtcccagcacggaaactatgatcctcaccgaacatgactttgatatagttatgtgcaattggctgatagtcacccgagaaattcagatcaatatccggcactttatcaccgtggaagcctaagaaagtttcaaacggaatatcgtggccatctttatgcaaatcagcgccgcatttagggcattgtttatctggcaaatcaaaaccggacccgatttcgccatgagtgaagaattcgctgtattgacagttaggacaacgataatgcggcggcagaggattaacctcagtaatgccggccatcgttgcggctagactggacccaactgatcctcgagagccaaccaagtatccgtctttattggacttcaaaaccagtcgttgcgcgatgttgtaaataacagagaacccgttaccgatgatactttttagttctttatcgagtcgctgcgccacaatgtctggtaaaggatcgccatacaattcatgcgccgtggtcatcacgtcatgtttcagattttcttccaccccaggtacttcaggtgtgtaaagcttatccttcaccggcgtaatatcatcgtcaacccagttggcaatcaagttagaattatcaactaccagctcgtgggccttctcttccccaagccaactaaaatcggtcagcatctcacttgtcgaacgaaaatgcacatctggcaaactgtggcgattgagtggattggctccgccttgactatgaatcagaatctgtcgataaatcgcgtcatgttgatccaaatagtgggcgtcgcctgtcgctacgactggtttttccagttccgatccgattttgatgattttttgaataatatcttttagatgtgcctcgcctttgatcaaaccagcctcgatcaaaggttgataggcaggtaatggttgcacttctagataatcatagaatgacgctttggcgcgggcctccgcttcgcctttttgcatcattgctgtgaaaacttcgccgctggaacaagccgaaccaactaacaagccttcacgcagtttttgcagctgactgcgtggcacccgtggcacccgatagaagtacttaacattagacaacgatactaatttgaaaaggtttttcaatcccgcttgtgttttcgcaaaaacaatcgcgtgacttggccgtgcagctttataggcatcccccgccccaacccgatcattcaactgattgagggtcgtcatgccatacatcttggccgcttctttttccaaagcataaagcagataaccagttgcctcggcatcggcattagcgcgatgatgatgttctaggctgactttgtactgcttcgccaaggtatcgagcttgtgattcttccgttctggatgcagcatccgcgacaattccaaggtatcgatgaccggattgtcaatatccgccaatccatgccgctcataaccattatccaaaaagccaacatcgaaagtcacattatgacccaccataatggcaccatcgcaaaactgctgaaacaatttgaaaacgtcgacttcagacttcgatccatgcaccatgtcatcagtgatatgtgtcaaattgatcgtcagttcagaaagtgggaaacccggatcgatcatttcttcgaattgatcaatcactttgccgtctttcattttgacggcagccaattcaatcactttgtcgtaaaccgctgataagccagtggtttcaacgtcaaaaaccacatattcagcgctggctaaatcacgcggctcatctgctcggtaagcaaccggcgtgccatcatcaactaagtttatctcgacgccatagagcatttttaaaccggctttgacagcggctgaatgcgcctctggataagcctgcaaacctgcatggtcagtgacagcaatcgccttatgcccccactctttagcccgcttcacatagtcgctaattggattcatagcgtccatttgactcatattggtgtgcagatgtaattcaacgcgtttctcaccttcagcatcatcggttgggtccggatgggagacagtttgaatatcctgtgcattaatcgtcagctcacgggaatagttgtcctcttgaacactgcctcgcacgcgtagccactgacctttttgaatccgcgcaaacatggcttcatcttctggaccattgctgaatttttttgcaatgaagctggagctatagtcagtcactttgaaaattagtaactgccgcttagaccgcagttcccgaacctcaacatcaaaaacatagccttcaaccgtcactgaacgttcctcttgcgtgatggtcaccatttgttgcggggcatcggtcattttcatctgccgccccatttgaactgggccgtcagtttgaacttgtttttgtttagccgcttgctgcttcactacttctgcagcagccttggccattttagcggtttcttcagctctttgagcctgaaaagccgccatcgattgggctgcttgttcctcatcaacttcggcttgcatccgtaagccagagaagccaacctgacgataagtttcttcgagcttaccgagcccttgctgaatcaagtattgccgaatttgctcattttcggttttgatcacagcacgatcattctcaagtgttggcacttgtttttcacataactcgcgaacaattcctgtcccaatttcggcatgggtcacgacgtactgccaatattgagctaataactcgtcagtaatggttggctgggttaccaccaccgataaatcagtcgcagcaatctgttgaaacactaacggcaacttggtcgcaattgcattgaaaatctgaaatggcaggatcgcgtcaaaccccaaagtgaaatcataacgccgagattgttcatgaatggtcacgttttgtaccgtgccgctggtcaacgaaggatcttgtcggacatctgccgccaagtcgagttgatccaataatttttcaaacatctcatgttgggataaagccaaattgtgcacccctcttagatggcaggtaacgaccaaagcagctgcttcagtcgtctcctcagtctatcaattatcttgctcttgcttattcagctgacccatcagaatcttgatcgagctgatcaattcttcttttttaacttcgattgtctcgccggttttacgcagtttcagttcaacaatctcgtcaaccgcttttttaccgaccgtgacacgtaatggtacaccaatcaaatcagaatctgcgaacttaacccctgggcgttcgttacgatcatcaaccaaaacactgtaacctgcatcttctagcattgtttcaatcgaagccgtcagtgacttttgttcttcgcgcttcagattaactggaatgagatgaatatcaaacggggcaatcgtggttggccaaactagcccgtgttcatctgcttgctgttccgcaatcgcagaaagcagacgggaaacgccaatcccatatgaacccatgatgatcggttgactgcggccattctcgtcaagaaaattagctcccatagtttccgtgtatcgggttcctaatttgaagatgtggccaatttcaatcccgcgtgtaaacttcaggacaccttggccatccggagaaacttcaccttcagtcacaaatcgaatatcggcataggtttccggggtaacatcacgatcaaaattgacgttaagcaaatgcgtgtgcgctttattagcccctgcgacaagattagtcagatcgcttagactattgtcggcaatgatccgcacgtctttatcgacatttaccggcccaatattaccgacttctgcgtgcatcacggtctgcacttgttcaggtgtcgccatatcaagaaagtcagcattcaacaaattctttaacttagtcggattgacttcatagtcaccacgaaccaaggccaataccggtgcgccatcagccatgaaaaggacagccttgatcaatttcttttctggtaccttcaagaattcagcgacttcagcgatcgttttggcatccttagtatcaacaggttcgagcgctgcctgttcttcgaccccttgttttggcaacgccatgctggttgccatttcaaggttcgctgcatagtcagaactatctgaataaacaatcgtatcttcaccaatatcagcaatcgcggaaaattcttttgaatccttaccacccatggcaccgccgtcaccgatgatcgaccgatagcgcaagcctaaccgatcaaagatattggtataagcatgttccatctgccgataaatggtatccaaatcctggtcattactagtaaaggaataagcatcttgcatgatgaattcccgaccacgtaaaacaccatagcgcggacgatcttcatcacgaaacttatcctgaatttgatacaacaccaatggcatccgcttgtaggattttaattcattacggaccaaatcggtgaaggtttcttcgtgcgtcgggcctaagatcattttccggtcctgacgattcttcaatttaaataaattaggaccgtaagtttcataacgtccggattcttcccataattcagctggcaagaggacaggcattttcattttaacagcatcgattttggtcatttcatcgtcaataatggcttcaatccgtgctaaaacgcgttccgcaagtggtaaataagcataaacgcctgcttgaatctgacgcacaaagccagaccgcaacatcatcttatgcgacttggcctccgctgagctcggtacttctttttctgtgggaataaacatccgtgattgtttcatgtcagcctccaaagctagaatattttaaaagtagcgcatgatatcgttgattgtgaccgctagcattaatagaaccatcaggcccaagccaatcatggtcacaacgccttccgtttccggttttaatggcttacggcgaataatttcgatcaggttcaaaagaattttaccaccatcaagcactggaatcggcaacaaattggtaatccctaagccgagactcaagtaacccataaagaagagtaatccttgaataccgcctttggcactttgactcgtcatggtataaataccaaccgggccagccagtttattgagtgaaaagccgccggtcaccatggatttgagcacgtcccaagtgcggacagccaaattccaagtttgagaaaagccaaaaggaatggcatttgctggggacttatcgacgtgtgcttcaaccccgatcttgccttctttattcggcttgatcacgatgttcttgcttttaccgttttccttcacggtaaatgtcactgatttaccggcatttttactgacgatctttgaaagatccgtgaatgatgacattttttgaccgtcaatcgtttgcaccgtcgcattggacttaagaccagcttctgcggctggataacctggcacaactgttccgatttggttggtattgagcacctgaacaccaaaaaacagaccgtaaataataaaagctagaatcgcgagtaagaagttattcatcggaccggcgaagttgaccaataatcggcgccaaaccggggcgttttgaaactgaacgtcttctggcgcgatctgaacctcggttccgtcttcttcaatgatcgtcgcatcgtggtcaacctgccaagtttgcaaggctgtttcatccccgtttggataaccttcaatcaccagatccttaactaaatcgacgcgactcacttgaaccggcattccgccggccaaagtcgttttgtcactggcattgatccggacaaccttgccttgatcgttaagaatcaggctcagcatcgtcccgggtttaatctcgtcctcctcatcttgccagccagccatgcggacgtatccgccaagtggtagcaaccgcagcgtgtaggtcgtattgttcttgtgcgacgcccacagcttcgggcccataccgatcgaaaattcccggactagaatgccgctgcgttttgcaaagtaaaaatggccaaactcgtgaactaccacaagaatgcagaagataacgataaaggcgatgatagtggtcataaaatctccttaatggttagacaatgccaaacagatgcagcatcggcaaaaccagcaacaaactgtcaaaacggtcgagaatcccaccgtgccctggaagaatcttgccggaatctttgacgccatagaagcgtttcaaagcagattcgattagatccccaatctgaccgataacggacaaaaatagggcgatccccatcatcggccagaaggtatagtactgcgggaagaacatcagatagatggcggcggtgatcaacgccagtgcaatcccgccaagactgccttcgatggttttattaggactgatagccggccacaacttatgacggcccaacttacggccaatcatataagccccagtgtccgtcagccacacgatcagcaaagcaaacatcaaggtgtccaagccagcatcattacgaacactaatcagataatgaaacccggtgccaatataaaagaaggacaatactgacacaccaatgtcatcaaaggtagttttattcttggtcgtgacggtcaggaatagcaacagcgctaccgcaatatatattaaatcgattcgtccaagaaaagcaggcagccagcggaaaaaactgttaggcagaacaaccaccagcacaccaagagcagcgattagataatcagccgaaaccagaattcgtttccgcatgataaacacttctgacaaagcgatcactgctaaaactgcaccggcaatatcaatccaaccgccaccagcaatcaaaatcggtataaagatagccaaggcaacgactgccgtaatgacccgttgtttcatcgtaataaatcctccattaccaaaaaatagctgttttatttttttaacccgccaaatcggcggtcccgtgcctgatattcagcaatcgctgcttctagagctgcaggcgaaaagtctggccaataatcatccacgaataccaactcactgtaagcaatctgccaaagcaagaaatttgaaattcgcagttcgccgctggtgcgaatcaataagtccggatcagctaggtcgccaagaaatccggtcatcaacgcattggcaaagtgacggtcatcaatatcatccggaaataactcgccttcctgaacttgtttagcgagcttttgtgctgcatggacaagctcgtcacgtccgccataattcaatgcaaagttaagaatcatgccggtattattggcggtgtcagccatggctttttcacttgcttgacgcgtttgcggcggcaagtcgtccagttcgcccatcacctcaactttaacattttccttgatcaagtcaggcatgaagtcattgaaaaaatcaaccggcaggcgcatgaggtaattgacctctgaacccggccgcttccagttttccgttgaaaaagcatacaaggtcaaaactttaacccctaagcgactggcagctttggtgatcgttttgacattttgcatgccttgtttatgaccggcaacacgcggtaaaaagcggcgtttcgcccaccggccattgccgtccatgatgatcgcaatatgagcgggaattcgcgcgggatcaagtttaactttagaagccttggatgtggccaaaatcggtgcctcctcataacgtcgatggtgtccttgcaccaaatgtctttaacgattgtagcagaaaaagaggcagagcgcgaactagcgcgggtataagtggggatattttattagtaacacggatctggacaacaggtgccattaaggtataggaaaagggtgagccataatttcctcgcaagacttgtgaccattaaatgtcgattaatcgtcggaaggttctaggcataaaatatgcttgccgtgccaaactccgcaatctccggccagctggggtggcgacgcggagctagagcggagacggcgcttcgagcccaaaaaccggtctcgaagtcgcctaacaacatcagctccacagcccgtcgctgtgttgtttgcacggctgagccccatctggcctacgattgctccgccttggcactacggtttttaaaatcgcagtaaatatttcatgagaaaccaaaaaggaacaatttttcaaatcgaaaattgttcctttttattgtctgactgagaattatgtcccagcctttttgttggccgctgaaattaaacttcagtaatttctttttctttagccgcagcgatttcatcgatgcgcttggtagcgtcatcagtagccttttgcatgtctttttctaagcgatgcaagtcgtcttcggtgatgtcaccgtctttttcttggcgcttgagtttgtcgagaccttcacggcgaatgttgcggaccgcgattttggcgctttcagagtatttgccgacttctttggcaatttctttacgccgttcgccggttaattgtggaatgaccaaacgaatgacatcgccatcgtttgctgggttgatgcctagatcactggcattaagcgcggtttcgatgttctttaatgaggacttgtcatatgggctcacttgcagaacacgcggctctggaatcgtaatggccgccatttggttgagcggtgtcggtgcaccataatattccaccgtaatctgattcaacagactggcgtttgctcggcctgctcgaatattgccaagttcgcgttgcaacgattcttcagttttacccatatttacttttgcttgatcaatgatttgatttgccattagcttctcccttcgattgttgtgccaatcttctggccttcaaccacgcgtttgatgttgcctggctcattgaggttaaagacgaccaaatcgatgtcgttgtccatggacaaggtgctggctgttgagtccatgactttgagatccttattgataatgtccatgtgggtcagactttcgtacttcactgcatgcgtatccttattcggatcagcagagtaaaccccatcaacattgtttttcgccatcagaatgacatcagcgccaatttctgcggcgcgtaaggcagcggttgtgtccgtgctaaagtacggattcccggtaccaccagcaaaaataaccacgcgacctttttctagatgacggattgccttgcgccgaatatatggttcagcaatttgccgcatttcaatggatgtttgaacgcgagtcggaacgccttgactttccaagttgtcctgcaatgctaatgcattcatgaccgttgccaacatgcccatgtaatcggcctgcgcacgttccattcccatttcggcgcctgtttcgccgcgccagatgttgccgccgccacaaacaatggcaatttgaaccccaagttcgtgcacttctttaatttgctttgcgatcgtcgcaatgaccggtggcttgatgccgaagccagcctcacctgccagcgcttcaccgctgatttttaatacgatccggttatatttgaccatgtatcctatacctccgttggttgctggcactattttaccatagtcgcagggtttctgcggaaagaagctgatttgaaattgagaattgcggaccgttattttccctcaccacggatcagggtaccccaaaaacacgcagtcacacggtgtatagcgcggaaaagaacggacgtttttaatttttcaagataagtaaaaagggacgctgccgagttgacagtgtcccttcaagcaattaacccttaatctgatccatcacttcatcagcaaagttttcttgtttcttttcaataccttcgccgacttcataacgaacgaagcccttcaccttgccgccttttgcagcaacgtacttagcaacggtttggtcaggatccttgacgaattcttggtccacaagggaaatttcgccgagccacttgttaacacggccttcaacgatacgtggcacgatcttttctggcttgccttcgtttttggtttcttctgtaaagatatcggtttgatgcttcaattcttctgccggtaccttggtccgatccaaatattcaggattgatggcagcaacatgcatcgcgacatctttggcagtgtcgtcatctgcgccttcgataacggtcaaggctgcgatttggccaccattgtgcagatacttgccaaagtgttcgttgtctgtcttttcaacaacttggaagcgacgcaggctgatcttttcgccgataactgtggttaaggcaattgcaccttcgtcaactgtctggccatcactcatcttggttgccttagcagcttcaaggtcggctggcttattagccgcaatcgctgcagcaacattattaacgtagtccttgaactgatcattcgaagcaacaaagtctgtttcggagttaacttcgataattgcagcggtattaccgttaaccgcaatttcggctaaaccttcggcggcaatattgccgctctttttagcagccttggccaagcccttttcacgcaaaacatcaatagctttgtccatatcgccatcagccgcaaccagtgcctttttagcatccatcatgccgacttgtgtccgatcgcgtaattccttaacttgtgcagcagtaatttgagccatggatctgatcctccttgatttaaaaaaggctgcctgcagatcttgcagtatgcgaaaccctcagacagcctattgtttaattaattattttgcacttttgttgtcgccttcaacggcttccacgatatcttccatggaatcagcctttttgtcggcagctacttgttgttcctgagcgtcgtcttgatcttcaccctgattgccttcaatgatagcatctgccatcttagaagtaatcagacgaacggcacggatagcatcgtcgttagaaggaatgatcacgtcaatgtcgtcagggtcggtgttagtatcaaccatcgcaacgatcggaatgttcagtttttgtgcttcctgaacagcaatcttttccttgcgtgggtcaacgatgaacaacacgtctggaatgcgaggcatgtcttcgataccgcccaagaacttctcaagcttatcttgttgcttcttaagaagagaaacttccttcttaggaagaacatcaaaggtgccatctgtggccatcttcttgatatccttgagacgcttgatccgagtctggatcgtgttccagttagtcaaagtaccacccaaccaacgatggttgacatagtattgaccggcacgagttgcttcttcagcaattgcgtcttgggcctgtttcttggtcccaacgaacaagaagacaccaccgttttgagcttcttctttaacaaaattgtaagcgtcgtcgatcatcttaacggtcttttgcagatcgatgatgtagatgccattacgttccgtaaagatatacggcttcatcttagggttccaacgacgggtctgatgaccaaaatgtacaccagcttcaagaagctgtttcatacttaatactgccatgcgtttgttcctccattatggttttattcctcttgacgacgtctcctcgcaagtggacttcaatcgaagcaccccactcacgatcaatcatcaatgtggtttgtgcatatcgcacttagaagattatacagacttttcttgactttgacaagagcgatcaccaccccggtttctggggtggtgatcgcgtttcggagcgtgatcagatttctgcgcctgagaacgcgtttttgaagcaactgcaagaaggtaatctttgcttcagttctattcttggtgggtaatctccggtagtccgagctggctccgcggcgattgggctggaacgcactggcacgacttcaagcccgcaaaacccgcggtcttgaagctcggccttggtctaggtggagaaaaccgctccacctagaccaacgtcagtgctgagcccatcgccgctccgccaactctctgctttctattctagaacctgagcaccagttgaccattgcatcattcgttaaatcatttaattgacatcaatcctgtttatcgccaatcaacctgatgatcttccaaaaagacttccttacgatgccgggtctgatgtttgaaatgccattctgccgagagcgcatcatgcttgtccgcaaaggcttcgtggtacaacaagcggaccggaagtcgttgggcagtgtatttagcgcctttcccggcattatgcgtggccacacgcgctttgacatcatcggtgaagccgccataaaaactgccatctgcgcataacaacacgtaaaagtaatacgttttagtcgccattcagcaacctcctcaccgatgacgagtatgtgccatccgcttcgtgaacgatcaatggtggcataattcgaatcccgtttggtcgaccggctttgatggcttcgattaataccatattcgcctcgcgatcttcccgcggatgaatgaactgcaaccgtttcggcgccaagccgaccaccgtcaaagtcgtcagtagttcggccagtcgttcaggtcgatgaacataaaaggctttaccttgatatttcaataaatccgcgctgacgcgtgctacggtggcaaaatcagtcgttaattcgtgccgagccaaggctaaatgatcatttggattagtgatactttgcgaactcactttaaaataaggtggattgcaggtgacgatgtcgactgaatctttggcaaccatttgggtggcatcagctaaatcaccgacttgaacagtcacattttgaagttgattcagcgccacacttcgcttcgccatatcagctaggcgcggctgtaattcaaccatggtcacctgctggtccgtgtcccttgccaaaaaaagtccgacagcaccgttcccggcggccagatcgaccacccggctgtgccgcttgacctcggcgaagttggccaaaagaaccgcatccagtgagaatgaaaaaacggctgaactctgaatgattttaatgtggcgactggccagaacatcaacccgttcacctggtaataatgacatcacgaacacctttttcctccgaagtgcgctatacaatggtataatttaccacaaagtttatccatgaaggaagaataagccatgttttatagttttctgcgttatatcattgccggtttaatctggctcatcaatggccacgcccaaactcaaaacaaacagcagctacctgaagggccgtttgttttggttgcgccgcaccgtacgtggctcgatcccgtttttctagcactggcttcgtggccgcatcatttttcatttatggccaaaagtgaattgttcaagaatcctttaatgcgctggctgttagtcaaagtgggcgcctttccagttgatcgagcccatcccggtcctagcgcgattaaagtaccggttcgtgcgttaaaagacgaacacaaagcgctcatgattttcccaactggctctcgctattcggctgatatgaaaggtggcgcgattctcattgcaaagctagccaaagcccccatcgtcccagctgtttatcaaggacctggttctttttggtcattatttaaacgtaagcctgcgattgtgcgcttcggtgcacctgttgaaccgcctaaaggtaagctgaccgacgaagcccttgccgcttttagtgacaagctgcaggaaaactttaacgcgctcgattacgcgatcaatccagagtacaagtatgtgcctgacaagaagaaatatctggaagaaaaggaacacggagaagtttaaggttcgctagtcgaacctttttcctttttattcaatacagaaagtgagcttgattcatgaatctttggaaacagatgacccgaaaacctgatgttcaggccgcactcaatgctgatcatttactgacacgcagtttaacaacgcgtgacctgatcgcgttaggtattggcgccgtcataggtacgggaatctttattcttcccggaacagtagcggcgactaccagcggaccagcgatcacgattgcttttattttggctgccatcgtctgctcgctagcggctatgtgttatgccgaatttgcatcggctctgccagttgccggctcggcttatgcttacggcaatctcgtgtttggtcaagtctttggatggattattggctgggcacttattttggaatatatgctggcagttgccgcggtttcaaccagtttttctgcgtatttcgctagtcttctacaaggctttcacatcactttgccagcagccattgccggtccgttttcgccgattcacggcacttatgtgaatctgattgcggtcattgttgttcttatcattggtgtcatgttgtcacgcggtatgcagtcctccatggcgattaatcgtttaatggtattagtgaagttactcattattgccatttttattgtcgttggctttttttacgttcagccagctaactggcatccatatttgccatttggtgcaaaaggcgtacttgccggtgctgcgatggttttctttgcctatctcggctttgacgccgtgtctgcttcagcaccagaggtcaaaaatccgcaacatacgctaccacgcggcatcatcggcactttagtcattgccaccattttgtatgtgttagtcgcgattgttttgaccggcatggtaccattcaccaaattagatgtggccgatccagttgcttttgccttgagcgccgtgcatctgcgtagcgttggcggtatcatttcggtaggcgccttggctggtatgttcaccatgatggtcaccatgatctacagctcatcaaggttgatttatgcgatcggccgtgacggactgttaccccgttggtttggtcacgttaaaggccatctgcctaaaaatgcgttgtggactgtggttttgatcattgcgatcatgggcggccttgtgccactcacgcaactagtcaacctcgtcaatatcggcaccttaattgcttttgccttcgtctcaattggcatcatccccttgcgccgacatcaagcctttaacaatgaaggtttcaaggttcctgggtatccagtgacgccgattatttcttttctgttttgtctgctattgatgacccagttaagtgtcgaaacttggattatgagtctgatctggtttgccttcggacttgtcatctacttcagctatggcatccgccatggtcatgttgccgagaaaagaattgaatgaatctgctgaattaagaaaggaaaataagtcttgatcaatcctcaaactgcaacctgcttggttgacggtaaagtctatgcgattagcgatggccttttcttaagcgacttggagcctaagttggccaatatcatcagaaacgactatccgaaggcgactaagaacagtttcatctgcaatcctcaccttctgacttatcggctagaacgcatgcggcgccaacaacggcaagatgcgcgtgcgcatgataaaatcaatcgaaaaatgtcgcaggctttggtcaaagacaactttcagctgaccaatgtttacgacaacatggaagcgacgattacttttggcgagcgaattgccgatgccgttgctaaatatgccggatcttggccattcattatcattttttctggttttatgattgtgtggatgatcctgaatacggtcggcattttcggagcgaaattcgatccatttcctttcattttgcttaacttatttctgagcatgatcgctgctttgcaagcaccactcattatgatgagccaaaatcgagcggccgaatatgatcgcttagaagcgaaaaatgattatcatgtcaatctaaaatcagaagaagaaatccgactgttacactcaaagttggatcacattatttcagatgacaaccccaacttatttgagagccaacgactcaccgttgaggttctgggtgaaatggtcaatcaactcactgaaacccgccagcaacttgaattgttaaaggcaacgcaggatcaggccaataaggatatagccattgatcaaaaaaacaaaaccaatgagtaatcatgtcaattcgatttatattgaaaaagatccccggtaccgtatgcaagcgtaattgcctgtacatggtactggggatctttttaatgatttgcatttattcggcatgatcgccaatttgcagatgatacatttcatagtatcggccacgcttggctaacaattcgtcatgcgtgccgcgttcaacaattcgacctgcattcaaaactaaaatcaggtcggcatcttgaatcgttgatagccgatgggcaattgcaattgtcgttcgcccttgccgaatccgacgcaagccttcttgaataacggactctgtttccgtatcaatgttggccgtcgcttcgtccagtacgagaattttcgggtcagtcaccactgtgcgggcaaaggaaatcagttgtcgttcgccgctggaaaactcagtgccaccttcaataaccttggcatgataggtgcctggtagtttatcgataaagcgatcagcttgcacaaactcagccgcctgtttcacttgctcatcggtgatactgtcattgaacaagcgaatgttgctactgatatcgccatagaacatgaatgaatcctgcaatactaatcctaattttttccgcaattctggcatgggatagtcacgaatgtccacgtcatcaattaaaatctggccttcaccaaactcgtagaaccgcatcataacgttgataatcgagctttttccggaaccggtgtgcccgaccaaggccacggtttctcccggattggcaacgaagctgatatcatgcaaaatatcgtgcttgccatcataagcaaaactgacgtgccggaattcgattttgccttgttggatcagcgcatgagcatcaggatgctgcgctggcgcatactcttgactgtcgagaatccgaaaaatccggctacccgcaacaacgccatcctgcaaaaacgaaaggttatccatcatattaaccatcggattaaagaagtttgccgtgtaagtcgtgaacgcatagatcagtccagcttccacgtaactatgcatcgaaatcaatccaaaggcccataaaaccgcaatcaacgcaaaggaatataacaagttaatcactgatgacagcaacaaagaattgacgcgaatcatcgccttacgtgagtccagatattcctcattcgtcgcttcgaattcttgactgatgcgattttcctgacgaaactgctgaatgatgccgatgccttcaatagattcgttcagttgggtattcaactctgacagtttttcacgcatgtgccgataaaccttggaactgtacgtgctgtaataccagaccactatgagcaaaatgggcagaaaggcagcgaccatcaaggctatctttggattggccgcaaacatgatggcaaaactgctaataactgagaataacccgacgataacagctaaaatgacgttccagaaatcggaaaatgtcattgtgtcattggtgacacgcgacacaatcgaaccagctggcgtttgatcaaaataccgcatacctaacgtgtgcagtttggcaaacagctgacggcgagcatcttctaagccgcgctctgcgcccatgttgaataaaaatgtctgaaaaaattggaaaacagctttaacgagcgtgccaaatgcatagagtgctgcaaacagcagcagaatctgaaccgttgcactttgattggccaaataacgatccatgaactgttggagaatgaatggtagcaaaacgttcatgcctgcaagcaacgcagccgccacaatggcgccaacgaactgtcgcttatacggcttagtgtaccccatcagccgcttcataattttgagttgttgtcgaatcggaatacttttcgaccaggcactctcataacccttacttgccaagtgattcaccttcttccgctgcttccatttcttgttttgcccacatttcggcataccagccatgcttggtaattaattgttcatgagtcccgcgctcaatcacctgaccattttcaaggacgagaatctcatccgcatgcatcactgagctgagacgatgagcagcaatgattgtcgtcttatgggcacgatcctgcttcatgttggctaaaatttcttcttcggttttagcatccactgcagacaaggcatcatcgagaatcaagagttcaggcgcgttgatcactgctcgtgcgatagacagccgttgcttttgaccgcctgacagactgactcctttttcacccaccagcgtgtcatagccagccgcaaactttttaatgtcctcgtgaacagcactttctttagccgcttgctcaacatcctgttgtcccttttcgaacgctgaaaagcgaatgttatcggcaactgttgtcgagaataagaagttgtcctgtggcacataaccgatcgaatctaacaaggcgtccagtgaataatctttgatattatggccgccaaactcaatcacgccatcgtagttatcaaactcgcgtaaaagcaacttaaaaatagtgctcttcccggcgccgaccttgccgacaatccctagcgtgtgaccttcaggcagcgtaaaatggacacggcttaaagcgacctgttgatcatccggataactaaatttattgatttgataacgaatatcgccatgcgctggtgtcgtaatcgcgtctttggcttcaaggatcgtcgacttttcctgcaacagttcatcgacccgatcataactggcattcccacgttctagaatgttaaacaatcggccaatcgcaaacatcggccacactaatgctgacacatacgtcacaaaggaaaccagttggccaatcgtgatttgtccatgaacgacctgccagccgccatagatgatcgtgatgacataggttaagcccatgatcagacttgtcgttggatcaaataaggcatcgatcatattcacgcgccgattaatttgcacggtatggtcgacaatttgattaaaatctgccgtatcttcggcttcctggccaaatgttttaatgactttaatgccgctgacactttcctgcgttttatcattcaaacgtgaaaaagccgcctgcgattcagaaaaagccgcatgcaagcgggtgcctagttttcgtgccatcaccgccaacaatggcattggcaaaatggcaacaatcgtcaaccgccagtcaacgaccaacaccatcgcaatgatggtggtgccgccagtaatcatggagtcgaacaaggttaaaataccggccccggcaacgttttgcaccgcgttcaggtcattggtcgcatgcgccatcaaatccccagtacggtgtttttgataaaacgtggcgtccattttcataaagtgccaaaataaccgcgtacgtaacgttcgttcaagcttcgcagcgccaccccagatcgcattacgccaaccaaaccggaataaatactgggcgaccccggaaaacagcaataaccccagcatccacgccaagtgactgctggttaaccgagatttgctcatcgcatcaacgagatccccaataacttttggcggaatcaaattcaccaaggctacgagcagcaaaaaagtaacgccgagcaaataccggcgccattcttgtttaaaataccaacctaattttctaaagattcccacgacactgctccttaacccttttgctcatggtttccccatcagcatctcaaaataattaacgttctctcatcatagcacaaacgcactgggacacgaaagcgcgatgacaaagtgattcctgtcatcgcgctttcttagcaattacttagcgttacgttgggcttgtttcatttgcgccatcatctggttcagtttcttagcagatggtttttgccccatctgcatcatcatcgtgcgcagcatttcttcgttcacaggcggattatcctgaaaatacttcttcatgtaagcccgtgccccgaagaaaccgcctgccaagccgaccagtaaggcaatgatccccacaagtactgtgattaacaatgtgcggcctccttcaagtttcattcttcattgtactaaagcaggttgacgttgaaaagactaatcttttcgccaaccgtgttcacgttgaatcttctgaacttttttgctagtgagctccttgccttttttatcaaagacctgcgtatgctcgatttgatctcgcaatccggcacgaaagtcctttaaataagcctcgcgcaattgttgacgctcgattttctcttcgggtgtcaaaccaacactgcgatcttttttagctaattcattgatacgatccagtcgttcttttggttgttctgccatcatgctacctcctacaatttcagtggcgtgcatcagttgagttgcactgcggcgtaacgataattcgccgcctcatgcttaggataaggcgcattctttaacatcgcaacatattctgcggctcgtcgttctgacgagaaggctttcaacaactcagtcggtgccgactgatccgcatagtagacgatgtagacaagctgatcatccatcagccttcacctcgagtctgtgagtgcttcttttttgcgtgtacgagttttccatcctactcatgcttcgctataacgcgcttgccagcccagaaacctgcacataagggcctcaagcctaatttggccaaagcccagccatttaggcttgaggccacttatgctccggtttctaagcgggctggctcacgctcaaaaaaaaagaccgtttgccggcctttttccagtattaacgacgcttttcgcggatacgagctgctttcccacgtaatgcgcgcaggtagtagagctttgcccgacgaacttggccgtgacgggtaacttcgatcttttcaacacgtggtgaatgtaacgggaatgtccgttccacaccaacgccgtttgagatcttacgtactgtataagtagcggaaatgccaacgccgtgacgcttgataacaacgccttcgaagagctggatacgttcgcgttcgccttcaacgatcttggcatggacacggacgttatcaccaggacggaagtctggaatgtcatcgcgtaactgtttcttggtaatttcttgaatcaatgggttcatgggtatttctcctttgccgacattcataatcatcccgaccagcggaatgtcgttgatgtgtgacgtatcacagtcaataagtttaccatgactggttggacgtgtaaaggtgaaaatctttacggtatgctagcgttcaggattgattcttcaatcttgcttctgccgccttagtagcttcttctgttttaacttctcgcaagagtttttgagcagtttgatcgagcgtaatggttttcaagagatctggacggcgaagataggtgcgacgaaggctttccttttggcgccagcgagcgatgagttggtgattgccattttggaggacttcgggcactttcatcccccggtattctggaggccgggtgtattgcggatactcgaggagaccgttctcgaagctatcggtgtgggcactttcatcattgccgagaacgcctggcaggagacggacaatagcgtcaatcatgaccatagcagggagttcaccaccagtgagaacgtaatcgcctaatgaatattcatcggtgacaagcgtgcggatgcgttcatcgtagccttcgtagtggccacagatgaagacgagatgatcttcttgcgataactctcgagcggcttgatggttgaacttcttaccagccggatccattaaaatgactcgctttggaccggggtgacgctcgttgacgccatccatcgcctcaaatagcggttctggtttcaacaacatgcctgcaccgccaccatatggcgtgtcatcaacatgatgatgcttgtcatgactatagctgcgataatccaccacatcaaaattaagtagctcgcgttcaatcgccttgccgatcatgctttcgcgcaacggctcaaacatattcggaaaaagacttaaaacatcaatctgcatcgtcaatcaacccttccggcacgatcacatgcgccactttctgatctaagtcgatggactggacaacggattttaggaaaggcagtaaaatatcgcttttaccgctacgaggaataacccacacgtcattgggacccgggcttaagatttcattgactttgccgagcgtctggccttgttcatcaataaccgttaagccgataatgtctttgtaatagtaacttccctcgtccagcggttgtaacgctgtctcggtaacttgtagtttcttgcctttaaatggcaggacttgattaatatcggtgtaatccttaaaggtcagcaaggtgagccccttgtgttctcgcacggattgaatcgttaaggcagtttttggtgatgttgccacataaacagtgttaccaaccttaaaacgatcggccgggaaatcggtcgtgacaaggacgcgtacttcgccacgaataccgtgcgtgttcacaatggtgccgatgtcataataatctggcatgttcttcctcctctaaacgcgctcgctggcccagaaacctccacataaggaccttgaacctaaatggccgcttatgctccggtttctaaccgggccagcgaacgctctttcaaaataaaaagaccgacgcggtatgcgtcagtctttttattctgcatgcgatgcatccaaaatattgagccgcacccgcttgttgtacgggcttttgacactatatacaatggttcggatcgcttgcgcaacccgaccttgtttgccgatcacgcggccgacatcttcaggtgccacagccaaatcaaaggcaatgtaatcacctgtttcatgcgcagtcaccttgacggcttctggttgtgtaaccaacggggtgacgattgcttgaatcaagctgccgatatccaccattgataaccgcctttatttcttggcaaagcgcgcttcgtgatacttctgcatgatgcccttgctaccaagcaagttacgtacagtatctgaaggttgtgcgcctttttgaagccagttcaaaatatcttcttcatttaatttcaaatcgactggattagtcaacgggttgtaatagcccacggcttcgatgaaacgaccgtcacgcggggagcgtgagtctgctacaacgatccggtagaaaggcttacgctttgaacccatccgctttaaacgaattttaactgccactaagtccacctcctgctcatttatcaaccttgatagcatagcaaaaatattttaagctgtaaagccttttttctttacacaggtaaaatgtgtcgtttggcaacggtcctgttcctaattggctggtcaggaaaaaattgatttttaggaatggaaacgcttggcatttttcagccgacgtttcttgttcttcttttgtttacggaccattgagttcatcgccattttgccaagtttgccagaaacgccgccgcccatgagaccgtcgaggcccttcatgttacctttgctcatctggttcatcatttgcttgctttgattaaactgcttaatcatccgattgacttcaaccactggccggccagaacctgcagccaaccgccgccgtcgacttggattgaggagatctggatcttcgcgttcttgcggtgtcatcgagtaaactatcgccttcatgtgggcaatgtctttcggatccattttgacattggccaaggctttgttgttcgccattcctgggatcattttcatgatatcttccagcggacccattttgctaatctgatccatttgatccagaaaatcattgaagtcaaaagaattctcgcgaattttttcagccatttccatggcttgtttttcatcgtaattattctgtgccttgtcaatcaaggtgagcatgtcgcccatgcccagaattcggttggccatgcgatcaggatagaagacatccagcgcatccatcttttcaccttgaccaatgaacttgatcggcttgccagtgacggcacgaatggacagtgcggcaccgccacgagtatccccgtccagtttggtcagaacaacaccggtgatatctagctgctcattgaagcctttagcaacatcaaccgcggcttgcccagtcatggcatcaacgacaagcaaaatgtcgttaggatgggctagttccttgatgtttttcagctcgttcatgagcttttcgtcaatctgcaatcggccggcggtatcgatcagtacataatcattcttattttctttggcagttgccaacccttggcgaacaatttcgaccggatcaacgtcggttcccatttcgaaaactggcacgttgagctgtttgccgatagtctgcaactgatcaatcgctgctggccggtaaacgtcagcagcgatcaataatggccgcgcactgtcattgtccatcagatacttggacaacttaccgacagttgtggttttcccggccccttgcaaaccagccatcatgatgacagtcggaatatgtggtgccttgttcagtggcactgccgcctcgcccatcgtcttgaccaactcgtcattgacgattttaatgatctgctgtgatggggttaaactttcaagcacttcagcgccaagcgccttggtgcggacgtttttaataaatgttttgacaacatcaaaattgacgtcggcttccaacaaagctaaacgaatttcgcgcattgcatcgcgaatatcgctttcactgaccttacccttacgccgcagtccgctgaaagccttctgcagtcgttctgataatccttcaaatgccataatttccccctgctatttcgcggtttgatccgcgactcgttctaataaggtacttaatgccttgtcgtctggataatgtgtacgtgcataactcactaacgtatctacagcttcattttgcgcttgatagttggcgaaaagatgcaacttcttttcatactcttccaagctagcctcggtgcgtcgaatgttgtcatacacggcctgacgcgagacgttaaactcggttgcaatctcgccgagtgagtaatcatcaccgtaatataatgccagataggcatgctgcttgtccgtcaataacggcccgtaaaactcaaacagcgagttcatgcgataatttttttcgatttccatcatgtcattcctttaatcccatgattgccggcaactcagtttccccggccgcttgaacatggtccttgtataaggataccggtatcgctgaaaatggtcaattacttaaaaaattaggttgatggccacggagctaaatgctagcgtagaaagccagcttcgactatcggtggataacagccaagaaatagggtcgaagaaaagattgctttcttgcaattgcttcaaaaacacatttgcatccgcagaaacctgcacataaggaccttgaagctaaatggccaaaacccagccatttagcttcaagaccacttatgctccggtttctaaccgcgcctgttcgcgctcttccagtttcccctagtttcgtggtacactgaacatgtgaaaaattggagggaagaatatggtctcaacctttatttactgggccgtgtttgccgctcttgctgcttggggactgtggagtttggtcttctcatgtgtttacctgagcaaccatgaaaacggcaatttgtggttctttgctatcattaatgcgattcttggccttctaggctggttattcgcttggatcatgagtaatacggcatggcaacaatactggtttgcaagtaaggtgcagccatctgcatggttcacctacctgctcatcggttaccttgtcttgattgtcctacaggtcatccttggccgggagaagaaagtgcaagcagcttaatgtcataaaaaaagcgtcgtactggtttttcgccagcacggcgctttttcgttattcctcattttaattaagcttcgaccttaatcaaacccttaaatagtccggccacaaatttagttggatcaaaagcttttaagtcgtccatcttttcaccaaggccgacaagtttgaccggtacatgcagttcattgcggattgccaacacaattccgcccttccctgaaccgtcaagttttgtcaaaacaattccagtgattttagttgtttgattaaactccttagcctgattaagtgcattttgaccggttgtcgcatccaaaaccagcaagacttcctgtggtgcatccggcaattcgcggacaatgacccgcttgattttgttaagctcattcatcaagttgaccttgttttgcaatcggccagctgtatcaacgagcacaacatcaaattgctcatccttggcgcgtttgacgccatcaaaaaccaccgcggccggatcgccgccttctttcgtggcaacgacaggtacatcaacccggcgaccccattcctgcaattgctggatggcaccagcacggaatgtatcggcagcaactagcagtacccgcttgccttcttcctttagctggtgggcaagcttgccgaccgttgttgtcttaccagcaccgttgacgccgacaaacaggaacacacttggccctgattcagcaaaatgtagggcattgtcttcatccttaccagcatcgccatacatatccaccagcttctccacaatcacacgggaaacggccttagggtctttggcatttttaagcttaacttcttcacgcaggtcgtcactaagcttaactgccgtttcaaagccgacatcagactcaatcagcatctcttcaagattgtcaaaaaagtcttcgtcgacactacgaaaattagcaaacagtgcattgagcttttcaccaaaactgctgcggcttttttctaggccctcatcatatttattttcttcaggcgtttccggttcatcaccggtaaacgcctttttgatcgcatcaaaaagtcccattaattgatcgcttctttctgtgattgatccagactaacagccataattcggctaacacctgattcttgcatcgtgacaccatacaatacattcgctgcaaccatcgtgccatgccggtgagtgatgacaataaattgtgtggcgctagcataatgccgtaagaattcaccaaatcgattgacattaacatcatctaacgaagcttcaacttcatcgaggatggagaatggtaccggacgcacttttaaaattgcaaataacagaacaatcgccgttagcgcccgttcgccaccggatagaagggaaagccgagtcagttttttgccaggcggctgagcggaaatctcgatccctgttgcgagcaaatcatccggattcgtaaggctcaaatgtgcatgaccgccaccaaacatttgcgggaaaattgcttcaaaagcactattggtctgatcaaacatatccttaaatcttgttttgaccgtttcatccaattcgtgcatcgtttcttctaactgctgcttagcctctagaagatcatcttgctgcttggtgagaaattcgtagcgttcattgacttccttaaactgatcaattgcgttgaggttcaccggtcccaactcatcaatgccacgctttaaaagcttgagtttacttttcaattcaggaattggcgcgtgatcggctgtcactgcttccttagcggcctcgtaagtcaactgataatcctcggctaaagtattcaaccgagcatccaaacctagtttaactcgattcaaagcaaccgcttgctgctcagaagttgccatagcttggtgttgctgctcataagtggtcgtaatacgcgccgatatttgactcagcttaccacgattttccgccttttgttgtgttaatttggtttgatccgccttgagctgctttaattcagtttgcaaattcgcgatcgtagcggtacgactggccttttctgcagcagtttcttcggccgtcgcagtaatgtgctcaattcgttgttgcaaatcggtcgcttgggcttgcgcatcccgtgcttgcgtctgccattgccgttgctggtcattcaaggtctgtaaatcattggttgtgactgctagcttggtcttcaacgcattaaccgttgctgcatgctgggtgctggatgccgttgccgccgcaacagccgccttagcattttcaatagttgcttgtgcttcagcaatatcttgaaccaattttttaccttggtgctgcaactcagttaatttggcactaagatctgcctgcgccgtatctgcttgttgtgccgctgccagctgacgttgcgcctgacgcaaggtttccgcttgggctgtgtgctgactcgtaattgttgtcaactttgcggttaatgcctgtgcctgttgggaagccgtttgccaagctgcctgggccacgttttcttttttcgtcaaagcagtcagatcagcttgctttgcctttaatgtttcaacaagcgtttgcagttggacctttaaatgccgggcctcttgactgcgagcaagcggcgatgcttggcgtccctgcttgacttggcccccagtcaacgaaccccccggatttaaaatgtcgccagctgttgtgacaattcgataacgatggtgggtggtattggcaatcgcgatggcatgtggcaaggtatccaccatcaaaacgctgccgagtaagttcgccatgacgtgtgccaaatctgcaggatattgggctaattgcaacccagtgcctaaaaagccttcagcaccttcaaccaactgtagaaccgcactgggcagctctctcggccgcataacggcagccggcaggaaagtcgccctacctgctcgttgttgcttgagcaggctaatggcgcgttgtgcagccgcttcgtcacgggtcacaatggcctgtaagttgctacccaaggctaagtcaaacgcctgttgataggcagttggaacctcaagtaattctgcgaccgcaccaatcactccgggaagttgatccttatgctttaaaaccacccgaaccccattgtaaaagccagcataatcatcattcagttcggataacgtttcatatcgcgcccgactgcgctgataagtggccagctcgtcttgataagcttgctgttgggccgcccgttgttgctgcaatagatcacgatcagttttggcctgctcaacggctgtttgctgttcatcaacctctgcttgcaactgttgctgttgcgtcaataatgcagtgaccttggcttcctgatcctgtgcatgtttacttagttcgtaaatccgacgatcatgcgctgcattttggctggcggctaactgttgatctttttgtaaagcagcctgagcatttttgttatcggcctgtgattttaacagatcaatataatgattctgggctacttccacttgttgattcagtttggctggatcctggtttgcctgcttttgctgggccaattcttgcttaattgcttgctctttttcggcggcagcagttgtttttgtcttaagttccttcagtcgctgatttgcttccgttaacgcttgttgagcacgcgccagtcgttcctttaaatcggccaacgtggtttcagcattagcagaacgttcactagataggttggcttctccgctaagattctcaagcttcatcgaccggctcaagacctggtcattcaactgattaagctggttctcaaactgtcgatctacggcacttaaccgctccgactgatcttccaaatctttaaccttcgccgtcaaagcggcgatggtttccttggtgaccttagcctcaccttgggttttctcctgttcggtcgctagttgttcgatctctaaggctaataaagtttgatgaatctgatgatactcgccggattgttgttgatagtccttagccaacgaagcctgctcacgtaatggttccacctgatgcttcaattccacgataatatcgttgatccgcgccagattatcatcgttattggcgagttctcgttctgctttggttttctgttgcttatatttataaacgccagcggcttcttcaataatgccccggcgttcttctggtttactattaaatatggcttcaacccgaccttgggaaatgaacgaaaagctttcacgccctaagccggaatccatgaacaaatccacgatatctttcagccgaacatcttgaccatttaataaaaattcagatgtcccatctcgataaagtcgccgagtgacagaaacttcatcaggttgatttttcagataaccatcatgattatcaaaagtcatcgtgacagatgcacgattaagcgctggtcgcgtatcagtgcctgcaaaaatcacatcgcccatccgttcgccgcgcaagcttttagcactttgttcgcctaaggcccagcggatggcctcagtgatattacttttgccactgccattaggtccgacaatcccagttaaactcgacacaaaatcaatctcagttttgtctgcaaatgatttgaagccattaatgattaaacgctttaattgcatgatgaccccaattctacttaccgtttcaagctggctaatgcagcttttgcagcagcttgctcagccgctttcttattcttgccaaaaccggtacccaaaacccggccatcgacttcgacatcaacgtggaactgccgctcatgggctggtccctgctcatctaataagtgataaacaatcgccacatcaccattttgctgcaaaacttcctgtaaagccgttttgtggtcttgatcggctgaaaactctcccgcatcaattttcgggaaaataatctgctgagcaaaccgaatgttggcatcgcgtccttgatcaaggtataaggcgccattgaaggcctcaaataaatcttctaacaacgttaagcgtttccgcgccccagccttttcctcacctttaccaagtttaatataccggtcgaaatgcgcttcttttgaaaaagccgagaaggccgctgtctgaacagccgctgcccgaattcgggtgagatcgccttcgggtttgtcgggaaacttgcgatacaaataatctgaaactgtcaattccaagacagcatcgcctaaaaattccaatcgttcattgtcttttaaacctaattctttatgttcattcacatatgaggaatgcgtaaacgcctcatccaaaagactgagatcatgaaactcgatcccataacgttgacgcaattcactcacaaactctgaggcaaccattaaaaatcctcctcgaaaatgcatgcatgagctcgtgaacggcttgggtcataagtttagaagtacctatcaggcgctggctatcacttctaagcagctgacacgccgttgctaaaccggacgcattcacgcgctctttttttattaccttctaattatacaagagcgcacaaaaaaagacacctgcgattgcaggtgtcctttaggatctagcgtttattacttagaagctcggttgttgctggtaacagcaatcttaccccagttcaaataatttgcagttgcatagtcaacactcgcgttctttacacgtttgtttactgggaaaatctcttggcgataaagcgttgggattgcgaaagcttcgtcattagcatatttctgccaagctttcaaagctttggcacgatatgcaggattcatcgccttttggccatcaatatcatccaacaactccgtattcttagaagaaacaaaacgggtatagttaaatggcgccttaattgagaatagatccattggtgaagggtcagaagaaagactccaagctgctgcataaacatcaacacccttgtcatccttttgaatcttgtcgtagaacgaattaaattcaattggacgcccggttgtcagcttaacgcgcaaaccaatctttttccactgttgaatgtaattttgcgccaaaggttgtgcggtcgacccaccagccattgttgcaaagttgattgtcaacttcttgccatcaggatcggtccgataaccatctttgcccttcttataaccggccttgtcaagcaagctgtttgccttcttgatgttcaagttataaccgtcaatgtcagcatggacatctttaccaaagactggcggaatcagggttgttgcacgggaacgagtgccattgtaaaacttagaagcaacctgatcgttgttcatcgcataacccattgcttgacgcaaactcttgttagccatctttgccttaggattatatacgttttcacctttactgtcgtcccacttacctaacttaaaaccaatgtaattataggcaagactttgatgtcccaagttatcataaccaccaatactcttccaatcgttgtaagtatcaggtggcatgttgtaaacgacatcatacttatgattcttcagcgcagatgtgatggaagctgtcgagacattttcaaaggtaatcttgttcaaacctggcttgcccttccaataatattggttaggagtgtattcaatgctttggccggcaacaatcttactcatcttgtatggtccgaagaacagtggttgcttacgcactttgtcactagattcaagtttgtcaaacgctacatcatgtaaatagtgatacggtgccgcattttcgaggaagtaaccgtttcctgaggtgttaaaggatggtttcatttctttaaaatgaataaccattgtgttaccattgtcgcccttaggcatggtcaaacctaaaattgaatcagcttttccatcgtgatattcggtcaagccttcaatattctgcaaagactcagtgtagcgttgactcttggttgctttattagccatgatctcgtaggcataaactaaatctcgcgcaacgacgggctgaccatcagaccacttaacattaggtttaatggtaaccgtcaacgtcttcgcactattgttctgctttaggcttgcagccccattattgttaaacttaaaggtgctgttataagcaaataatgattctgcagcaggttgcatatattgataatcgtagttatcagtataaagctcttcgttgaaaacccccttaaatggtgagtcatcaaccaccgccacattgacattgccgcccttgatcgccttggcggagttgttataagaaactgggaacttcacagctttattagttgtacttgagctggagttcgagctcttactaccacaggctaccaaggtaattgataaagcggtagcgagcgtgatcattccgagcacagaacgctttttcatacttcttcccccttccgcgtcgtcatcgcactatgtaaacgaagcaacgcttcatgtgagttaaatgatagcataattagaacaaaaaaaccaatatttgggcacaatttttactttttttcttcaaaaaaagagagacacttcgatttctctaagtgtctctccagcaattttcagaaaatagaacttaaactcacccacgacgctgtcttgaatccgccgcacgccgtaatgcctggcccacaaaattgatcgatagagataatgtcaacaacaccaatacagctggaaaccaaacccaccaacgattaaaaatcaaatctgggttggatgcatatcctatgagcgtgcctaaacttggcgtctccatcggtaagccaaagcccaagaatgacagtgctgtttcaatcccaatagagctcgcgatggtcaaggtcaaatcagtaatgatcaatgagctgatatttggcaagacgccggcgaacatgatcttgaaattagacgtccccgatgttttcgaggccatgacatactcactacgcgcttcagagagaactagtgatcgcatcagtcgggtggtcgtcatccagtagaatgccgccataatcaaaataatggtgatgacgttgtactgcggaataatcgtgaccaggacaatgataaccagcaatgatggaatgatcatccaaaaatcgaccaatcgcatgatcacagcgtcaatccaaccgccaaagtagcctgagattgtgcctagcacgacacctacaaattcaatgatcaaggcaacggaaatcccaatggtgatcgagtttcgcgctgcaaagaacagatatttgaacatgtcacggccgccttcatcagtaccaaggatatagccgcctgttccaggcgccatgtagcgatccaaaatattaacctctgttgcaccaccgacattgaacatcattgagccaatgaatgcagcgaggatgatgaacactgctaggattaacgaaacgacagcaactttatctttgcgaaattcattcaaaatcaccttgaagttagaaggtgattgttcaactttggtggttgctgccacctcatttgcattattttgcataagttttccccaccttctactcgatccggatccgcggatccacgatactcatgatgatatctgacagcaaattccctaacaacgtcaggaaaccaaatagcaacaccagagagatgacaactggatagtcacgactggtcatagaagaaacaaacagttggcccattccgggataactgaacactgtttccagaataaccgatccacccagtaacatggtaatttggttccccataaacgccgcaatcggcaataaggagttacgcaaaatatgtttgttgaagatgacgcgatccggaaccccttttgaacgggcagtccggacaaaatcttgtctcgtattatcaataacaccagttcgcaaatactgaatcgtgcttggtgtggtgataatcccagcaaccaaggctggcagaatcatgtgataaatacggtcccagacataccctaacgtgcccggattataagtggatgacacactaccaccggttgggaaccactgcaggaagaacccgaagaaaattaaacccaatagataaaagacgaatggcggtaccgccatcaaaatgaaagagccaacagagatagctgaatcccgcttggtgccttcgtaacggccggcaataaccccggctggaatagcgataacgtacagaataaccgttgacattaaggccaaccagaaagtgttcacggcgcgttcgccaatcagaccggtaacagaacgtttataaacaaagctctggcccaaatcaccgtggaacatattgccaacccatttgaagtactgaatataccaaggatcattcaaaccatattgctggcgtaatgctgccatctgcgcagcactttgaccttgcgagaaattaccagtcaatggatccccgggcatcatctttgatagcatgaaaaccaggacgcttaacaagatcaattgcgggatcatgattaagacccgtcgcagaattgttttccacattaatcatgcactcccttcatcgttgaatctggcagcgcaacaaaatgtgtgtcggaaatcttctggagatccaaaacgcggccttctttagaataatattttgattcttcttctttaaaaacacgttcgacttcacgacgatgctctttattcttcttccgatcatcagggttgatgtcaggaatcgcagaaagcagtcgctgtgtgtagatgtgctgtggatggttatagatatcttcacgtgagccgatttcaacaaagcggccgcgatgcatgatcgccatgttcttacacatgtgcttcacaacacctaagtcatgggaaataaacagataagaaatattgtattcctcttgaatccgcttcatgaagttcagcacctgcgcctgaaccgacaagtccaacgcagagactggttcatcagcgataatgagcttcgggtttgttgccatagcacgagcaaccccgattcgctgacgttggccgccggaaaactcatgcggatacttgtacaaagcatcgcttggcatgccaacaatatcgagcagttcttggacgcgccgacgttcttcatccccagtaagattctgaaaattgcgaattggttcagcaataatatcctcaattcgctttcgtggattcaaactagataaagagtcctgaaaaatcatttgaacgtctttgttgtactgcatatgtttccgcacactgcgtttggtaatatcctgcccttgatacataatcgagccggacgtgaccggttccaaacccacgattgctttgcctgtggtggatttccctgaaccggattcgccaattaacccatatgtttcaccttgttcaatatcaaagtcgatcccatcgactgccaaaacatggtccgtcactcgattaaaaaaccctgagcgaatcggataatgaatttttagatttctaacctcaatcattgccataatttactcacctttttcagctgcttgttcgtcatccgggaaatagaagtccttgtagcaggtacactgaacaaagtgatcagggccaacttcgtgcatgatcggatgctcttcatgggctgatgcaggaatccaaggaatccgagccgcaaaccgacaaccttctatctgcatattcttcaatgatggcacaacgccttgaatgacatgtaattcgtcgtcatctgaatctgtctgtggcatggagcgaagtaaactgcgcgtgtatgggtgcgttggatgcttgaaaacatccattaccgaaccactttcaacaatttggcccgcatacataactgccacacgatcggccgtttcagcaacaacgccaagatcatgcgtaattaaaataatgccagaatgcatttcccgttggatgtcttccaacagatccagaatttgggcctgaatcgtcacatccaaagcagttgttggttcgtcagcgatgataatcggtggtttgcaggcaatcgcaatggcaatcacaatccgctgccgcataccgcctgacaattcgtgcggatatgaacgtgccgttcgctcagggttgggaataccaacttggttcagtaattccaagacgcgactttcacgctcttctttgttcatcttagtgtgatagaccagtgtttcttcaatctgctcaccaatccgcatcaatgggttcaaagcagccaatggatcttgaaagatcatgccaatatctttaccacgaattcggtcaaaaagggcctcattcaagccaacaagattaagattgttgtacaaaatatcgccagtgaccttcgtattgcgcggatcatgaaggccgataatactggttgccaaagtacttttaccagaacccgattcgccaacaatagctaagatctcatcttttcgtaacgtgatgctgacatcatcgaccgcatcataatagtcgtctccgagtctgaatcccgtgtgcagatgttgcacatccagcagcaaatcttcaggtttatccaagcgaactcctcctttgcgtcctcgacgcaagattaaaacaagatgagatttttgaaataattgtctctaagtataaagaaattatagcggttatgcaagcgaaaaatgcgttctaaagctgttttgccatgtcaaaagcgaaaatttgatggcatcattttgggccctggtcgccgaaatttagcgaactgtgggcgctcaatgagttcgtagcagcgaatatttcgaaaagaataatcttttgatgtgtcgaccgttgcaacttcttatctgtggccaacatcttcggttcgctgaaagacaaacgccatccccaagaccttatccgtcagcgtctcagggacagtgcccaggtgcgctcatcacgctccagatcaaggtctattacacgatggtttctagccaagcaaactcttaaaaaaagccgtccatctctggtcggctttttgtcacttctgatgggcgttgatgtaatcaacggcatcttgaactgttttgatgttttcggcgtcgtcatcggggatttctgctccgaaggcatcttctaactctaaaacaaattcaacgatgtcaattgaatccgcatcaagatccttttgaaagttgagtgtcgggctgattttatcgggacttagttgaaaatggtcctgaattaggccggcaattttttgataaatttcgtcttcactcatgttgctcctccattcatctgccaatttagtgtacttgtttgccactggaatgtctacgctttctcagcggttttcgcttcggcaacttctggatgggcatcaaaataatcggcaactttcgcaacggtgccattttgaaccattttggcggtttgcagcaaagtataataaacggtctctgcatctgccgcaccatgagccttgattaaaggtgccttgagccccagcaagaccgcgccgccgtatgacgaaatatcaaaggttgaggccatcgccttgagattacccttcaggaacaaaccgcctaatttgccggaaaggccaccttcatagatggcccccttcagcatgtgcatgaccgtccgcacagtgccttcaattgccttaagcgttgcgttaccggtgaaaccgtccgtcaccacaacatcggcagggccgtttaggatatcactagactcaacgttaccaacaaaattaatccccggagccgcagctaataaatcatgagcctcttgatgcattttgtcgcctttgttggcttcagtgccattgttcagcaaaccaactcgtggattttcaacgccgcgaacatctttagcatagtaactgcccatgatggcatattgtaacagatgatacggtcgattttcagcgttggcaccgacgtccagcatcacaaagcctttgccgtcaactgtcggcaaggttggtaacaaaccagggcgttcaatggcacgaatgcggccgataataaacaagcctgccgccaacaaagctccagttgagccgagtgaaaccatcgcgtctgcctcgccttgtttaacggcttgagcggctaagaccatggaagcctgttttttgcggcggatagcacgaacgggttcatcgtcgctgttaattttttccggagtatgaatgattgttaaccgttcatcatgatgaataagcggtttaatttttgcttcatccccgtacaaaagaaatgtcaattctttgttggcatctctagctttttcgaccccggcaatgacaacttctggggcgttgtcgccacccatggcatcaatcgcaattttcattcaattcgttcctttcaagttttaatccaaactaccgagcatctgccggctttccgccaagtaagcggcaagcggctgatggtcagactgcagcaaatgtggatcggttttaaaaatctgggccacaatcttttgcgcagcttctagggttggaaaatcgccaactggatcagcgactttgaactctggtaaaccagattgcttatctccaaaaatatcacctgaaccgcgcatttccaaatctttttgggcaagtaagaacccgtcgttggtcttggtcataatttccatgcgggcaattccttgctcatttttgggatcagcgataagcagacactgtgctgctttttgcccacgtccgacacgcccgcgcaactgatgcagttgagaaagtccaaagcgatcagcatcaaaaattgccatgacagtggcattaggcacgtccacaccaacttcaacgacggtggtcgaaaccagaaccgcgatcttcccatcgctaaaagcacgcataatctgatccttctcatccggcttcatctgtccatgcaataacgcaacagggccaagattgccgaccgctttttgcatatcaacaaaaagctgctcggcattttgcaaatcaattttttcggattcggcaatcaaaggggtgatcgcaaacacctgactgcctgactgcacctgttcacgaatgattcgataaacttggtcaatctgatttttgcgcagccacgtggtcgcgatcggcttgcgacccgcaggtaattcatcaatcgtggagacatccatttccccataggctgtaatggccagtgttcggggaataggcgtcgctgtcattgacaacaaatccggcttttgtcctttttcttgaaggatcttgcgctgattaaccccaaatcgatgctgttcatcaataacaaccagaccgagcgcatgaaagtcgacccctttttgaatcaacgcgtgcgtgccgatgatgagattcaggcggccatcacgcaactcacttaggagctcgcgccgctttttggttgacgtcgagccagtcaacaaacctaatttgactggaaaatctttgaataactttgtcaatttggcaaaatgctgctcagctaacacttcagtcggcaccattaaagccgcctgaaaaccagcggtcaccgccgcatacaaaacaatggcggcaacaaccgttttaccgctcccaacatcgccttgtagcagtcgattcatatgatttggccgccgcatatcggcacaaatttcgtttaccacgcgtttttgagcattcgtgagcgcaaacggcaatgtcgctattaacgcgcgcaaggcctgattgtcataaggaatcgccaacccgttgctgctgttggcattcagttgttttaacgcctgaatttgcaattggaaaaggaaaaactcccggaaaaccccagtacggcgagccgcctttgcttctgccggcgtatcaggaaaatgcatgccatgaaccaactgagcatcactcattaagcgataatgctcgcgaatgctggcaggtaccaaatcgttgatattttgctgatcgcgttcccaggcagttttgatcaagtcgagtaacgtccccatgcggacatttttgttgacggtgtaaatcgccgccatcgacggttgatcctgcgactgtgtcgcgagaattttcatgccggtcagactacgacgcttggcatcccattttccaaagattgctgcttcatcacccatctgaaaacgatcttttaaccatggttgattaaaaaacgtcaccagaatcacgctacgttcaatttggagcttcacgttaacgcgactacgatgcggcccaaatcgactaataaccggatcagtcacaacgatccccttgaccgtcaatttttcctgatcggctgcctcggcaagatccttcaccttcaaatcatcgtagcggtaaggaaaataaaataggagatctctaatggtgtgaataccaaggcttgccagcccagcttcacgtttcggaccaacaccaggtagaacagtaacgggatcagtcaaagccatcaaggcacctcctttttcagaatatagcaaaccactaatgagtgtgttactgaccatctggcctaatgacgccaatcgcacgcttttatataaatttcgcaaaaaggtgccccgcatgcgggacacctgtacgcgatagctgtttaagcctactcaactgagacgaaataaggataaaccggttgatcaccttgatggatttcaaattccaaatccggatattgcttaccgacagcatcggcaatcgcctttgcttccgtttgattagcatccgcacccacgatgatggtcacaatttcactatcgtcattgatcattttaccaatcatcgcaatccctgctgcttcgcgatccttatcagtcactgtgatcgtaccgtcgataatccccatccagtcgtgatctttgatcgccaaaccgttgatcgtcgtatcacggatggctcgggtgattgacccgctgatcacattcggtagttgggcagtcatttcactttgattagtggctagatctgcatcaggactgtaccctagcatcgcggtcattccttggttgatcgtcttacttttgaccactgcaacttcaacgtcagtcgccgcttttgccgctgcttccgcggccatgaagatattgccattgttaggcaagacgatcacgtgcttggcatgcgctgctttaaccgcatccaaaatatcgtttgtgcttggattcatagtctgaccgccattgagcacatgcgtcacgccaagactcttgaatagttctccgagtccttgaccagccgcaatcgcaacgacacccatttcagctaacggcttttgggccacttgttgatccaatgcgccttcacgttcaataatgctttcctgttgcaagcgcatgttatcaactttgattttcatcaatgaaccaaattgctgaccataacggaaaacagtccccggatgctcagtatgaacgtgcaccttgaccacttcttcatcagaaataaccaaggtcgagtcaccgagtgtattcaaatagttacggaacggttcgtagtcaaaatgtttgaggttttggccatcaccaagttcgaccatcatttcggtacagtagccgtatacgatatcggctggatcaagctgtacttgagcactttgatgatgcacagcattaatcatttcgttcatttcttcgtcagtgacgtcatgaacatctgaactaattttaccggacaagccttcttggaaaccctcgtaaataaaaacaagtccttgtccaccagaatcaaccacgccgacttctttcaagacggccaaaagatcaggcgttttggctaaggcacgtttagcacctttcacaactgcctgcataacaactaaagcatcatcagagccattagccgcttttaagccagctttagccgcttcacgggcgactgtcaggatcgtgccttcaaccggcttcatgacggctttataggccgtctcgacgccatgtgcaaacgcatcggctaggtcctgagccgtcagacttttcttatgcgccacgctttttgcaaagccacggaaaagttgcgagctaatgacgccagaattgcctcgcgcgcccatcagcaaacctttgccaagatgcttggctaagtcaccaactgactcatcattagactccaacaccgcttttgcgccagtttgaaaagtcaggttcatattagtgccagtatcaccatccggaactggaaaaacgtttaatgaattcacaaaatcagcatttttattgatgcgatgtgcggctacccggatcatatcctggaatttagtcgcggtaatttcggttactgccacggaacatcctcctcgaagaacttcaatatgtcacaccgttaacaaccggtgcgtgtacgtcagtcgcctaataccttgacgccttggacgatgacggtcacttcatcagtcgtgacccccaacatcgtttcgaggttgtattttactttgtcttggacatttcggcaaacttctgaaattttagtgccataactgacgataatgttgacttcgattttcacgccattatctgtctgacgaacgacaacaccgcgcgaataattttcgcgtttcaaaatgtcattgagattatcgcgaatctgattacggctagccatgccgacgataccatagatggatgtcgccgcaccgccaaccaccgtcgcaatgacactgttggaaatgtcgatgattccgtatttggttttgattttgaccgccatgctgtttcctcctaagccattcgcgatgattttcacatcgcgtacaattctaccagctagtttagcatagctaagcgatgactgcgagcagagcgtgaatcagcccgattagaaaccggagtgtaagcggccttgggtgtgatggccggtttttggccattgcgcccaagaccgcttacacgtcagtttctggtcttgtcgctacctttatgagacaatcgttaacagtaacattttccaaagaatatcggactatttgtacttacccacccaattttcttagactctgatcacgcgtttattttgacctgtcaagtaattttactttgcaaaaattcttgcattaaccgcgggcctatgataagttagttgagtgaaaaattcgagggtgaccttgaaaaaaaggaggtcatattgtggctaaagatattattactggtcgtcataccacgtttggcaacaagcgttctcacgctttgaattcaagccggcgccaatggaaagccaacctgcacaaggttcgtatccttgtcgatggtaaaccaaagcgggtatgggtttctgcacgtgcccttaaatcaggtaaactgacccgggtttgatcccataacattggctctacgtcaactggtgttgaagaataaatttatcatttgaggcggttctccatttggggagccgtctttgtcatgttatgccgtgatttggtagattcgtttaaagaagttcagctgattcttgaagccaaaacaggatcgtttgagtgacttgatgaggcggttaaccccttcgatcggaccgttggaataagggctggtgacagcggcgagaacagcgactttgtgtcgcttaagcgtcgcgatcgtcatgtccattgccgtaccgtttggctcgtaagtagctaacaggtttgccagttccgtgggatgtttcttcaccatcaaggcatcatgaagcgctaagtaggtctcgtaggtttgcttgagcttgggctcagtatcaagtgcgatatcgatggcctcctgttgcgtgacgtattcattcaaaccaaacaggaactgtttgtgtttagcgtcaggcgcagtttgatgaaaaagccgccagtttgtcttcatgatcttataaggacggctgtgtttgtcatcaagctgtttgagcgcttggacgcgtacctgatcaagggcacgagccgcaagttgaatgatatggaaccgatcaatgacgacttgggccttggggaaaacctcatgaataatcgtctgataagctgcattcatgtccatggtgaccgtctggacccgagtgcgttcagcgagtgaataatgagcgatgaagaagtttttaatcgtgcggttgaatcgatcaccaagcaaggctatcagatgatgtgaatcggcatcaagacagataaacgacatcatgccatgagtagaacggaactcatcaaagcagagtcgcgtgggcagccggcgagccggtcggagtttgagattttggtcaatgatccgttgaaccgaggaagctgagattccgataatacgggcgatggttttgactggcaaccgttcatgcgctaacttcatgattcgctctgtcatgtgagtggcgatcgtgtggttgggttgcacgagtggcgtcttggcactgactgtgtggtaacagttataacagcgccatcgttgcttgtgcaagtcaatgactgtcggcatttcaaccccattgaggacgcgcacgtgggccgtataaaacccgttagggtgcaaggcctcaaagccacacagtgggcaccgggttaaccggtaagtcagctcggcatcaatcacatgatactggcggcgacgtaccccgttgccgcgatattcatgacgaacaaaagcaactttgatattatggtctggtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttctcaacaccagaaagtgtagacccataacatttaaaaaggtcctgacaatgaatgtgatgcatccttcattgtcaggaccttttttttgttgagcgcgagcaggagcgattagaaaccggagcgtacccggattttaagcggttgacctaatatccctcatacaatcggtgattcgttggacgccaactaatttgggaaagccttgggctaaaatttccttgccatgccaaacgccgcaatctccggccagttgggactggtacgcactttttcaggatcttgatatgctgacttctcagatcgttagttcattaaagcaaatcaggaagaaaacaatgcctaattatccaatttttgcccgcgccgatcacgactataaataattgccacctgaccagtcgtccaactcacggtgaatggctgcttgccaagaaactcattggaagcccacgcataaggatagcccgctcgccatggttttaatggatatttcgctccgacaatggtcaaatcggcaactggggtgagattgacaactgcaacgtaacgataacctggcagcggtttaatttcatgctcaccagggctgtaataatcaacccaattttgcacatcaaacaaatgaaggcgctcaatatctgctaaaaagcgcggttgaagcggtaagaaaagattagacaaaaaatgatctagtcgtccaccagtcccgccaaccaaggtgacgtcgccggatgaagatgcctgaagtgccgctttaacagccaactctgtatccgtgtcatctttttcagaaggcacctgttgtagcttctggacatgtccacgaactagccgcaattcttcaagcgttaaggaatcaaagtcgccaattgccagttcaggatgaatccctgcacgtacaagtcgcaatgtgccgcgatcaacgccgatccatacaccgggcaattgttcccaagcggctggcaagcatgcctgtggaccgcctgccatgatgttgacgtgcgtcatttaacagcctcacgcaagctattcatcgcgtcaccgacatttttggacccaaaaacatacgaacctgcaacaaaaatatctgtcccggcatcagctgccgccttcacggtttgattgttgataccgccatcgacttcaatgtcaaaatgcagtttccgagctttacgcagctgatataatcgatcaaccttgtccaccatcggcgtcaaaaatttttgaccaccaaaaccgggattaaccgtcataaccagcacttgatcaaccagcgggagaacttcttcaagactgctcaatggtgtgcccggattgatcacaaccccagcgcgaacacctttttcgatcacatgctgcaaaacgccataaagatgatccgtggcttcttcgtgaaccaaaatcgtatccgccccagcttcagcaaaatctgccacccaagccgctgggtcactgaccatcaagtgaacctccaatggcagactggtaaccggacgtaacgcttggacgaccagcggaccgaaagtcagatttgatacaaaatgaccgtccataacatcaacatgcagtaaatcagcaccggctttttcaactttttcgacatcccgcgcaagatgagcaaaatcagcacttaaaatcgatggggcaattttcataacgatctcctccatatattgcgttcatccggccattaatcagcttgacgtccgcattttgtctaatctaagttacttcttcttgtaaactgggcgcttgccgcttaactcttcacgaaactgtaagtagttatcataacggctttgcatgatatcgccagccgccagtgccgccttaacggcacaatgtggctcgctaacgtgctgacagccgcggaatttgcaattgggtgctaacgccacaaactcaggaaaacggtcacgcaaatcatctaaggtgacgtccagtaaaccaagcgatgaaaaaccaggtgtatcagcaactaagccaccgtgaatcggataaagatcagtggtgcgggtcgtgtgccggccacgatttaacgcatgactaatggccgctgttgccaagtccaatcctggcacaagatgattcaacaaagtagacttaccagcaccggtttgtccagtgaaaatggtcaatttatcggcaaagctcgcttgtacttgcgcgaggattgtcggatcaaagggcttgtcaggtgcaaaaaccggatagcctatttttgtatagccggctaagtcttgacgaatcttcgttaatcgctgaggctttgttaaatcggtcttggtcagataaatctccgcgtgaatatcgtgaccctcaagataaaccagaaaacgatccaataggttcttagaaaagtccggctccacggcggaagtgatcaaaacggcttgatcaacgttggcaaccggtgggcgcaccaacgcattatgacgcggtaataccttcagcaaatagccttcatcatccccttctcccggttgaaaagcagcaaagtcgcccaccagcggcgtaattttgtcgttgcgcaaactgccgcgcccgcgagttcggtaagttgtcccattcacagcgatgtcgtaatacccgctgatctgtttaataattcttccagttaagttttcactcattgcgtaatattatctccctgtgaaataacagtgccgtcccgaacaatccggtagctacctgggtatttcgcgctaacttgcaatgtgatggtgacttgatcgtctgccgtgatattaaaggaactatacacagtattaatgttatgtgtcttatctgcgatgaagacttgaataccgttgggtgcgggcgcagcactactactgctactagtgctgccactgctattgctggcacttgcggtactcgaactggccggtgcttgatagggaattgaaattgttttcgaccaggttttggtctcttcaggatctgggccttgagagaccgaaacattgactgtgtcgcctggtttaacctgtgtcccagcagctggcgtttgactgattaccatgcctgtatcgacggtatcagagtgcgcttgagaaatcacaatcttaagtccgacttcattggcgtaatctcgcaaacttttttcggtataacccgtcaaatcacgaagcgcaaaagtatttggcttgatcgcaacggaaacaccaaatgtgatcgtcgttttgtccgcaatgacctttttgcctgctttaatgctttgtgacacgatcttgcctgacggttcgtcattggtgctgacctgtttttctttgacggttacgccgcgtttttgcaagtctgacttcacgtctgtgtaatcttgcccaacataattctctagcgtaaattgcggctgaccgcggcttaaaatcagcttgaccgtcgagccttccttaacactcacctgccgttttggatctgaatcgatcaccaaatccttgctaactttcgtggaataagtgtacttgtatgacccaacttttaagcctgcgctggtcaaggcagtttttgcctgggttgtggtcatgccccgtagatcggggacgtccacatcccttttctgattggcaaaaactgcgccgataccaatcatcagcagcatggcgacaagtatcccgatgccaataatccaccaacggcgactttttttcttaggtcgtgctttcggacttggctgactcgctggactgtcagcatctcctccttcgtcatgcggcggtttgggaccgttggggatgactggcatgattcgtgtctcatccagatcatctttaggaaccacatactttgcttcatgtgctcgtgccggactcaacgctgtcttgaggtcgctagccatggcatccgcactggtatagcgattagccggatttttggctgtagccttaaaaacaacattctccagtgcctgcgggatatgcggatcaaacgcgcgcaccgacggaatttcttcttgaaaatgctttaacgcaatcgtaactgccgaatcaccttcgaaaggtacagaaccagtcagcatttcaaaaagaataatgcctaacgcataaatatcactttgacgggttggcatactgccgcgcgcctgttccggtgatagatagtgcaccgaccccaataatgagttggtcatcgtcatcgaattctccgataacgcgactgcaatcccaaaatcggtgatcttagcattgccatccggatcaatcaaaatattctgcggtttcaaatcacggtgaatgatattgtgatcatgcgccgtctgaacggcagaaaggatctgttccatcatgtcgaccacgcgctgatatggaatggggaaatgctcgacaatgtagtgctttaaatcagagcctttgacatactccatgaccagaaattgctgaccttgactttcaccaacgtcataaatcgacacaatatttggatgaaccagctcactggtcgccatggcttctcgttgaaagcggcgaactgtatcggggtcattttgcaaatcaagccggagaaccttaaccgccacatcgcgatcaagaatcaggtcgcgtgccaaatagacgttggccataccgccttcgcctaatgttttgataagcttgtagcgctcatttaaaatcgtccccggctcaatcattgcggctccctccgatcctgatgaatgatcaaggcactgatgttgtcaggtccgccagcagcatttgctttgaggatcaattcttgagccttgctgccaatcggcatgtcctgacgcaacactgccgcgatatcttcattgtcaaccatgttggtgaggccatcagaacacaacaacaaatagtcgtcatattccatatcgtaaatcgtcacatcagcatcaacatcactgctgacaccaagcgaacgcgtgatcacgttacgctgcggaaagcgtttggcttcctcaggggttagttccccatgtttgaccaactcattgaccaaactatgatcctcagtaatttgaactaaatggccattgcgatagaggtagccacgtgaatcaccaatatttgccaccacgaatcgtgtaccgctgataatcacagccacaaccgttgtgcccatcccagaaagatctgtatattgtttcgctttttgcaaaatcacatcattttcctgctgcaactcaaaaatgagccaacggacgatggactcgatctcggcagtatctgttttctcgaaagcatagcctaaatgcgatactgccatttcactggcaacatcaccacctcgatggccacccatgccatccgccaccaaggccaaagtcgcttcggattgatttttaaaaataccgacatagtcttgattatttggtcgccgacgaccaatatcagtgcgataagcgaactccatacatacccctcatttgcgacgaatcaaactggcaatgaaaaatccgtccgtatcataatcatctggaaacagttgcaacgctggtgcgttatgcgccttgtgcaatggcttcaaggttggtactgaaacttgctcgaactcaggatgagccgccaaaaattgtgcaaccacatcttgattctcttctttcaccattgtacatgtactatacgtcaggcggccaccgatttttaaggttggtgccacactatttaagattgctagctgaatttgttgcaaatgcgccggatcttcaggcgtttttgtgtacttgatttccggtttacgtcgaattaaacctaatccggaacaaggggcatccaccaaaattttgtcaaaagaattggcagaaaatgttgtcgcaaccttacgtgcatccagcacctgtgcatggatgcgatccgtcaagcccaggcgtttagcatttttattgatcaaacgcactttgttggcgtgcagatcaagcgccgtcacttgtccgccttgttttggatcaagatactgagcaatgtgggtggttttaccgccaggagcggcacaagcatccaaaacaacatccccaggctggatgtctagacttggggccaccagcatcgaactttcatcttgcatcgtatactcacctttgacaaatgcggatgtccctgctaagtggccactaggtgcaatgaggccaattggggtcaaaggactttccttcaaatcggggaattccggctttaaagaagcaagcaaggcagctggggtgattttcgtcgtgttgacgcgcagtgaagcatgcgctgggacattgatgacattcaaaatggcacgggttttcggttcacccagttgtgccgtcaatttttcaacaagccacaccggcgtactgctttcgattgacaatcgcttcacaggatcagcgattgcggctgggtcaggaaagcctgttcgctgagcatttcgcaaaaccccagtcacaaatttggcgattccttgatgtccaagcttcttggcaatttctgtactatcaaaaaaaaccgcgcgtgctggtactttatcaagatactgcagttgataaacggctgtatcaagcaaacaccgaatccaattgtcgagtttccggcctttgatgaaaggtgccagataaaaatccaacgtcagctgatgctggatcacaccatagacgatgtttgtcagcaagccagcatcacgcggcgtcaacttgtgactattaatcacgtgatccaatgtcagatttgaatagccaccttgcccagtgactcgcgacagggtttcaacagctaataaacgcggattattcggggtcatcagtaatcacctgctgtcctgagaccaattgttggcccggtccattcaaaaagtcggcaattgattgtttagccttgccagccggctgtagttcatccacttggaaagtggtttgttggccggcaaccatcaccaaacgatgcttatcccgttcaacaatactgccagcaggaagcgttgatcctgctgatagcggcgtaatcgcccacaacttcgtccgttgaccatttaaataaacatacccgccgacatcgggacgcaacgcccgaatccattgatcaagggccttggctggcagatgaatattaagatgctcttgctctttggtaatggtcggcgaaaaggtcactttatctggatcttgaggggtccgggtggccgtgccagcaatgatcttcggcaacgtttctagtaacaaatcgcgaccgagcaatgacaatttggcaaaaacggttcccgtatcatcagcacgcgtcaatggcagttttgcctgcgcaaacatatcaccagcatccattttcttcaccatttcgataatcgtgacgccagtttctgaatcgccattcataatgctgtactgaatcggcgcgccaccgcgatattttggcagcagcgaaccgtgcacattcacagcgataattttggctgcttctaaaaattttgttggtaaaaattggccatatgccgccgtgacaatcaagtctggtgccatggcgatggcttgcgtcaactctgggctgccgctcaatttttccggttgcaaaaccgggatatcatgtttctgcgccgcctgtttaactgggctagccgccagccgctgcttgcggccaactttgcgatcgggctgcgtcatcacggcaagaatgtcgtaatgctgggcaatcagtccttcaagaatcgggacagcaaattcgggtgtacctaaaaaaattactgaagtcattttttcctccaaacaatgagttgctggtatgttggtgcctagtttgccttggaacatggttaagacgtttaaacgaatgccaacggttctggatcaatcgcgactaaaaagccgtgacgactactttgctgggtctcttccaaaatatgctgcagggttgccgctaacgccggctcgtgtttatattttagaacgatttggtaaatatagcgatttttcaaacgagcaatcggtcctggtgtcgggccaagcatgatgacctgatcggatagatgctcacgtaattcttttgccaaagaaaagatagccttagccgcctgtgtttcatcaacatggctcacagcgattttcgttgaataaaaatatggcggataattgccgcgatgccgaatggccatctcttgccggaaaaagccttcgtagtcctgccgtttggcgtattgaatggcataatgatctggattgaaggtctgaacgaagacttcaccgggtttgtccgcccgaccagcccggccactcacctgtgtgagcaactgaaaggtcttctcactcgcccgaaaatccggcaggccgagcgctgtgtccgcattaatgacaccaactaaagtcacatcgggaaaatccagtccctttgcgatcatttgcgtacccagtaagatatcggcctgatggtcaccaaacgcatctaagatccgcgcatggccacctttgcgccgagtggtatcaacatccattcgcaagattcgggcatctggcagcagctgctgcaactgcgcctcaaccttttgggtgccagtaccgtaatagcgaattttatcagaaccgcagtttgggcaacgatgtggaatcggttcctcatggccgcaataatgacatttcaaggtgtgtgtgtccatgtgcagcgtcagactaatgtcacagttcggacattttgccacatagccgcaatcgcgacacatcacaaaacttgaataaccgcgccgattcaagagcaacacactttgttcctgtcgctgtagtcgaattctcaaggcgtcaagcagcgggcccgaaaagtcctcttgcgcgccgtgcgcaaaggcttcccgcatatcaacaatatgcactggcggtaatggttgatcgttaatccgatgcggcagccgcagcagtgtataaacgcccttttccgctcgagcgcgcgactccaatgaaggtgttgctgagcccaacacaaccggtgcatggtgaatctgtgcccgttttaacaaaacgtcacgggcgtgatagcgtggcgccgaatcttgtttgtagctggtctcgtgctcttcatccatgatgaaaacgccgatgttttttaacggcgcaaatgctgctgaccgtgcgccgacaacgacctgagcctcgccgcgcgcaattcggcgccattcatcatacttttcgccatcagacaagccagagtgcatcacggcaacatgcgtcccaaaacggccttttacgcgattgaccatttgcggcgtcaacgcaatttccggcacaagcatcaaggctgtctgtcccgcggctaaaacccgtgcaatcacctgcaaatagacttctgttttgccagagccggtgaccccttctaacaaaaatgttttaggatccctttcggcaacggcagcgttaatttgcgtcacaatcgtctgttgttctggcgtgagcggcaacggcttcgtcaacggttgatgctgcagttccggataaggatcgcggtaagtctcgtggccttcaagcttcagccagcctttttcgactgcctgattaatcaccggctttgtcaggccatattgatgttcaacggtcatcaaagcaggatgctgattgttagcagcccattcaccaattaaagttaacagtttaagttgcttggcggcgtttttacgcacgtgttcacgctcggcagccgcttgctccggtgataattgcgggatcaagtaaaagatttttttaacccgagcacgatccttttttaaatatgaaatagcaactttacctgcttgcgccaatttcatcactgcaacttgctgttcagcgttcagactaccgatcgccagactgtcagccgtcccaaagtatttttgttgctcaccagccgacagcttaaccggttcagcaacttttaccgcatcgattttcaacatagttggcaacatcgtctgcatgcacgcaatccaaaaagaatacgttgtttgcgccaaccacttcgatagctttaataattcgtggtccaaaaccggggccggatcaaggacatctagcaatggtttcaattgaccgtcatagtcgctttggtcggagactgacacgaccatgccgctcacttttcgcgcgcctttgccaaactggacccagacccgcatccccgcctgcaaagcgccttctaagcgcgcaggtacaagataatcaaacggtcgatctgtttgcatcgtgggcacatccacgatcaccttggcaacaattgccaagcgctcaccccttttgttttgctaacatcgttgcaagttgctcaatcaaagcagcagcgacttttggcttgggcatttccggcaaggtcactggtgcctgttctggccgcaataacgtcacagcattcgtatcagcgttaaacccgtgagtcgcatcaacgtgattggccacaatcatatcagcatttttcttagttaatttaagttgcgcatttttcaaaagatcattggtctcagccgcaaacccaatcaatatctgatgagtttttttacggccaagtgatgccaaaatgtccggattttgaaccaaattcagcgtcagtccagaagtcgcatcagtcttctttaacttgtgatcactgacggttggcaaccgataatcagcaactgccgctgccatgataaccgcgtctgcctcggtaaattcggcatcaattgtgtctgccatggattgggcactttcgacttgtttgactgtcacaccgggaacaactggtaactgtcgcgttgtgaccagcgtcacttcggcaccagctccggccgcggcattggcaatcgccgtgcccatcttacctgaagagtcgtttgtaaggtagcggacaggatcaagtcgttctttggttccgccggcagaaacgatgatacggcgaccacgtaaccgcgggtcatctaaactttcgatgaataaggcaatccgttctggctcaggcattctcccgataccggcatagccttccgctaacaagccagtttcaggtggaagcacgagatagttttgttcagtcatcaaactagcaatattcttttgcgtctgcggattttgccacatctggtcgttcatggccgggaccaacaactttggtgcctgcattgccagcagtgtcgtcgtcacaacattatcagcaaggccgttcgccagtttagccaacgtattggccgttgccggtaccacaacaccaagatccgcccaatgtgccaatgccacatgggcaacatgttcaggatgatcaaattcatgcccgtctgtcaatacagccgccttgctgacgatagccaacgtctccggcgtgacaaatcgttccgcacttttggtcatcgcaacccgtacatcatggcctgctttgattaaggctcggaccagtaatggcactttataagcggcaatcccgccagtgacaaacaaggcaatatgttgcttcttcatgtcgactcctttcgcacttcaagctaggaccattataccaaacgcacactaaaaagaggcaggagcacttttaagcgccactgcctcctgtattgccagccgtctttaaacgccattgtcatcagacagccagaacgatcaatcgctcattcctgatccttgcgatccaatttttctgcatcacgctcaagcattttagacttaggatcaatgatgacatcaccagccgcaatttcttcaagcgctttgccaacacttttatcagacttataatctgacaacatcttcaaatcaccagattctaattcatgggcacgttttgccgccaatacggctagcgaataacgggacggcaccttttccaatagtttatcaatcgaaggataaataatcatgagatgaaactcctttttctaatagatgggcatgaaccccgcgctatgcgagccagccacagacaactatcttgccaaatctgcacttgctaacatgcccttgtaacgatcaatgacgcgtggcacccgcaagtgctcgctttcaataatacgttcgatgcgcttaactgctaaatcaactttatcattcaccacggcataatcataattttccatcatggtgatttccgaagctgctttgcgaatccgtttatcaatggtcacatcatcatccgtgccgcgtcctttcaaccggtggcgcaactcgctaagatctggtggtgtcaagaagatgaagacaccgtttggacattttttgcgaacctgcatggcaccgttaacctcgatctccagtagaacatcgcggccggcatccaaagtttcgttcacatattttaacggtgtgccgtagtaattctcaacatatttcgcatactccagcataccacctgtcgcaatttcgtgctcaaactgggctttcgtcctaaagtaataatcgacaccatcaacctcaccaggccgcatttgccgtgtcgtcattgaaattgaatattgaaaatctcgataattaccatccagcattgcttgccgaaccgttcccttaccgacaccgctgggcccggacaaaacaattagcattccccgctcgtgcatgtgtgaacctctttcgttaagtattactgaacattttgcactttttcgaggctgatttcaactgcatcaccggtgaaatggtgaaaagtgcgcccgtttgagggcaatctgagcatcacggcgccccaaagcaatcatattagcgatggcttcaggccgaaaattaaacaatccaggcagccgctcactgggtttaagatagagatcgccatgatcagggccaatgcggccaattccttcgccgctaatcgcgatgacataatcagcaccaatttgccgcgcaatgtcaacaggcaagtcattaacaaccccgccatcaacataactcaccccggcccgctcaactggcgaaaaaacgcctggcatggcgcttgaagcaagcaaccactcccgcgcctcaggtgcagtcaacacatccagtcgggtcacatgtgcttgaaaatccgggacactggttgtcactgctaacaccgcccgcgaatcgagtttgggggcttgcagcattcgatctaatactggcacaaaatgacgccgcaaaaagatcggtccattcacttttgcttcggaaaaatgctgccaccattgtggtacttgctcgggcagcatacgggcggttccggcagcattgatggcgccaattgacgacccaatcacaaatgtcggacgtaatcgcggccccaatacggcccacacgccggcttggtatgcgccgtgagcagcaccgccgccaaaaacaactgctattgttgccatcgcttgttcccccccaaacggcgtgatccactgatttaaaaaaactagttgcaactttgaacacttgttcgtataatgaaattacaaacaaatgttcggaggcttgatcatggaaaacaaatcatctgcactgcaaaccgttacccgtcatctcgtcgcatcttatcgtgaattcttcgatttggcggcaccaactgcaaaaatgccttcccatcagcttgatcttttccttgatcaggccatgcatcgccagtatcaagtggcgctgttctttgatcaagatcggccaccatttatcggtcgcattactcggccattgggtgagaaacggtatctggtcaaagcataccatagtaacgtctatcggatcatcaccgaagcggaggtatcctacattaaacgatttaaatgatcggtgttggccggttgcgcagtgtcgcgcgctaccatcatgccattcatcgcaggctgttgatcatcgaatccgaattttagggcttgcatgaatggcatttaattcagatgggattcatcaccaccaactaaagcgacgttaaggtttctttctagctgctatataaagacgcctgattttcctaaatatggaaaatcaggcgtctttcgtttggcatagatcacttattggaaactaaaactgataccgtcaaagcaaagaaaccattgaccaaatgtactgtcgtagacaattcagtcacttaacccatgcgtccgtgtttgaattcgtctgccattttcaacaattcttccgcatgttcaactgttagcttggtgattttctccccagctagcattcgcgcaatctcatcaacgcgggcctgatcggttaatttcagaacttgcgtcgtagtgcggccattatgaaccgccttactgatgacatattcatgatcagccatcgccgccacctgaggcaaatgggtgatgcacaacacctgcgaagacttagcaatcaagctaatcttattggcaatcgcctgcgcgactcgaccggaaacgccggtatcgacctcatcaaaaatgatagccgtcacaccttctgttttcgcaaaaatcgtcttcatcgctaacatcaaccgcgacaattcaccgccagaggcaattttagctaacggtttagctgactcaccaggatttgtttgaatataaaattcaacctcatccagtccatcagcccgaaaatcctttgccttagcaaaatgcaccgaaaaaactgttttttccatatacaatgatgctaactgctcgtgaatcgctttcgtcaattgcttagcggcggcatggcggcgttttgacaaagccgttcccagcttctgcaactgattctgggatgccttcaatgtcgtatcaagatcttcaaccgaagtttctgcttgttccatttggttcaattcagtcgcggcccgcttgccataggcgatcacttcatcaagcgattccccatatttgcgctttaactgattaaataaatcaagccgcttttcgacttcatccagccgaccttcgtcaaattcctgatcatccaattccttcgacaagtcattttggacatcttgcaagctgtaataggcgctttgcaaattgtcagcaatggcagcaaaattcggatcaagatcagcaatactttgcatactcgacatggcctgaccgatttgatcaagcgcattcacttcttcatcactcaataaagcatagctctcctgcaatgctgaattaatcttttgaaaattagcaagcctttcacgttctgcagtaagatccgtatcttcatgcggttgcagattggcactttgaatctcacccacctgaaatttcaacatatccaagcgttgtgcccattcctgctcgttcgcctgtttttgcttcacggcacgcaaggtccgttgataatcgtgataaacatcagcgtattgttgccgcaatttcagcaagtcatcgccggcaaacgaatccaataaccctagatgcgtttctggatgcatgagctgttggtgttcattttgcccgtgaatatcaaccagcgtttcgccgatcgccttcaaggtcgttgtattgaccagatgcccgttcacacgacaaacattacggccagtgcgaaaaatttcgcgctgcaacagtacggtgtcattttgatctggatccatgaccccatatgcttgcagcttagcctctgttgccggattttcttgcgcatcaaagagaccttctaaactggccttagtggtgccggtacgaataaaatcgactgagccgcggccacctgccaacaagccaactgcatcgataatgatcgacttaccggcacctgtttcacctgtcaaagcggtcataccgggctgaaaactcagcgccagatgatcaatgatggcgaaatcatgaatcgctaactcttgtaacatcgcttcaccccaccattgcttcaagttcagccaacactgccgttgcatattttgcagaccggcagatgatcaaaatagacgcatccccgctgatggtcgcaaaaatacgctgatcatccagttgttcaattaaagtctcaactgctgccgctgtcccaggcaataaggccaaatgaataaaattatccatggcctcaccccacttcatcgcggtgatgagcgttcgccgcaatttatcagtggctggcaattgtttttctgccggcatactgtaacgataatggccttcaccagcaggcactttgatcaactgcatgtccttaatatcacgcgaaatggttgcttgcgtgaccggaatatgcagctcattcaatcgcgcaaccaagtcttcctgacgttcgattggttcatcttgaatcaatcgttgaatggttgcctgtcgttcgcgcttgcgcatgtgctcacctctgtcatagatggctttgttcgatcaaaactagtcaaacaaaagctttaccaatagcatagcgcacgaactagacagataccaagtttttgcataaatattcattatggccgatgtaaatcaccataagcggcagtcaaagtttcttcaatatcgacatcaggcgccattttcccaggcgtttgcgcactattttgcagatgaattaaaaattcaatattaccttcgccgcctttgatcggactgtaatccaatcccaagacatcgtatccagcctcaagtgcgaaatcaacgatcattttcagcacgtctcggtggacctgcggatcgcgaacaatcccgtgtttgccaacattagcaggccccgcctcaaattgcggcttaatgagggcaaccgcatgaccaccgggaatcagaattgcttttaacggcggcaaaataagctttaatgaaataaagctgacatccgtcattgcaaactcaactggaccatcagtgaagtcttccggcttactataccgaaagttaacccgctccattactttgacccgaggatcttcacgcagtttccacgccaattgattatagccaacgtctaatgcataactcatcttggcgccgttttgtaaggcaacgtctgtgaagccgccggtcgaggccccgatatccaaaacggttttgtccttcaagtcaatattgaagactttcaaggctttcgctaacttcaacccaccgcgactgacataaggcatttttttgcctttcacatgcaaaatagcatcgccagcaatttttacgcctggtttgtcgagtcgctgattgttctgatcatagacttcgccagccatcactgatcgctttgcttgctcacgagattcaaataaaccttgttcaactagcaaaacatcaacgcgttcttttttgatttttgtcatgctttcaacaccgccaaaatctcagccaatggcgccgcgtcaactgtcaattcgtttaacgccgtctcagcttttgcaatttctacctgcaaagcttggatagcaccgtccaaccccaataactcgggaaaagtgttcttatgctcaatgacatctttatcagccgtttttccgagttcagccgttgttttggtcacatcgttaatatcatctttaatttgaaatcctaagccaaaagcggccgaaaaatcagccagtgctgtttggtcagtctccggaatggtcacaaacagcccgcccatcgcgattgcggcttggatcaaggcgccagtcttagcttcatgcatgcgtttcaaagtttcgagatggtactgctcgttttcaccgtccatatcgagcacttggccaccaaccataccgttgctgccagcggcttcggccagaatctgcacacatgcgacgcctttttcagggtactggcggcttaaaatagcaaacgcatcggtcagcaaggcatcgccagccaaaatcgctaaggcttcgccaaactgcttatgattggtcggcttcccgcggcgcagatcatcgtcgtccattgccggcagatcatcgtgaatcaatgaataagtatgcacatattccaaagcagcagcagccggcagtgcatcagcaatcacaccgtcatacatcgccacgacactcaacaacaacaatggtcgcaggcgcttgccacctgcctctacggaataaaccattgccgctcgcaaatgcgggttagcaacagcagctaattgctcgtccaacgtctgttcaacggctgtgcgccatcctgctaacatagggctcattgctgatcatcctttggcgaaaatggttgcgtcgtcccatcgtcactgaccatttcggtaacggttttttctgcagtttttaatgttttctcaaggtcctgactcaatttaacaccggctttaaattgatctaatgccttttccagcggtacatcgccttgctcaagctgattcacgatgttttccaattgtgcaagtttctcttcaaaagtaggttcagccatgtgttttctcctttgtggtgacgtgtgcgccgacttgtccatcagccacgtgaatatgaatatcttgatctagctcgtagtcacttagacttttcagcatctgaccttgttcatcggtcacgtaagcaaatccgcggcccaagatttttaacggacttaggtgatcaaggccactcacggcactagcaaatgcctgacgcttagttttcaccaaaccgcgcatcgcttgatccaagcgatgacgatccccagtcacttgccgctgcaaattgaccaatcggataaacagttgccggccatccaattgggaagttgccattgccaaacgatgatcagcatcgcgcaggcgattatgcatactctgttgtagccgttgttgaaattgatcgactcgctgaacgtattgatcataaagtcgatccggttgcgtcaacacaacactttgtgcagaacgctgcactcgaatcgcggcatttttgagccgattatgcatggcattgaccagtcgcacccgatcttcagaaattcgattaagcgcatcaatcaatgtcacgggcgttacaatttccgccgcagcagttggcgttgccgcccgtcgatcggcaataaaatcggtaatggttgtatcggtttcatgccccactgagctgacaaccggcatcggcatgtcgaccaatgcgcgcgcaactttttcctcgttaaaaggccaaagatcttcaattgaaccaccaccgcggccaataatcacagcatcgaatccacctattgttttaatctggtttaatcgtttcaccagtgaatcggcggcttgatcgccttggacaactgccgggaacagcgttaattgcaaaatcggatagcggcgtgcgaccgtcgtcatgatatcttgaatgacggcaccacttgggctggtcacaactgccacccgtttgggaaagagtggcagtggtcgttggttgcggtcaaatagcccttcagccgccaactttttcttcagttgctcaaaagcttgataaagcgcacccacaccatctggttcgagatgttcgacaattaaacgatattcgccgctgggttcatataaactgactcgcccaacaactaggactttcataccttcctcaaggtcaaattgaaccttgctgaaggcattacgaaacatcagcgcaccgattttagcgtgatcgtctttgagtgagaaatactgattacctacacgtttgcgataattggaaatttcacccgtcagatagactttggcaaggtaagggtccgcatcaaatttgcgtttgagatattgagtgagtgccgtgacgcttaaatattgactggcatcaaccatttgctcgcctcttagccaaggtcactgtctgggccatgagcgaagcaattgtcattggccccacaccacctggtactggcgtgatggcgctggcaatcggcgccaccgcggcttcgtcaacatccccaagtagcttaccgtcagctccacgcgaaataccaacgtcaatgaccactgcacctggtttcaccgcatcggcaccaataaaatgcggcaccccaacagcaaccaccaaaatatcagcttcttttgccagctgtttaagatcacgggttttactatgcgcaattgtgacggtggcatcgtgattgaccattaaaccagccagcggccgaccgacaatgtttgaacggccaatgatcacaacccgtttgcccgcaacatcaatatcataagcatccaacaacgccatgatgccataaggcgtggacgccacaacagttggttcattggcccataaccgccctacactaaccggactaaacccgtcaacatctttatcaggatcgatagcatcaatcaccgcctgttcatcaagtcctgctggtaacggcaactgaaccaaaatagcatcaatatccggatcatgattcaactcggcaaccttcgccagcaagtccgcctgcgttgtcgcttcaggcattcgaaacattaaagaacgcacgccaatatcttctgcacggcgctgtttattacgtacataaacctcactggccggatttgatcccaccaaaacaactgccaatgtcggcgtcacatcgtgttgtgccaattcagcaatggtttgcttaaggtctgccagtattttctttgaaactgctctgccatctagtcgggttgccaagagcttcactcctcattttatcggcgcttgttgcgcgcaatcgtcacttatcaatatgcgaacatagtacgaccaaagcaagataaatcaaaaccggtcaaagcaaatgcctttgaccggttgacttatgcttgcggcgttgcttgaatgaagttcgccaaaatgccattcacaaacttggctgattgatcatcgctgtaacgctttgccaaattgatggcctcattaatcgccgcagcttccggcatcgcttcttcataacgaatttcgtatagacctaatcgcaggatgattaaatccggcttcgtcaagcgactaagggtccagcctttttttaattgcggcgtcaaggcagcatccaaatcagcctgtttactcaaaacaccctcaaccagcgtggttaaataagccggcacctcggtatcttgaggtaaaacttcggcatacaccgcatctttatcagcttccggattggttgccaaggcaaacagcgcctgaaaagcagcctcacggatcgcatgtcgtgattccatcttattcgtcatccttgccgctagcgctttctgcatcgtcagtgtcggtatcatcgtcgttgaacagattatcagggtcaactttttcagctttttctggaatgatgccaacaacgtggacattaacctcgctgagcgtcaaatctgtcatgaacaaaagctgttcccgtaaccgttcctgcatcgtcagtgccactttaggaaccgagacgccatagtctagatacacataaacgtcagcggcaatctgatcatccgtcaccgtcacactgacgcctttgccatgattagcccggccgaaccaggcgttaattgaagcacccagtgagccgcgcatttgatagacaccatctacttgactagccgcgatgcccaagatgacttccaaaacttcaggaacaatctcaatagtcccctgtgcatcggtgcgattcgctaatatgatatttgtttcttcagccatcgtgagaacctcctaagccctagttgttggcgcgtgaaatgtaggtgccatcatcagtattgatcgttaaaacatcgtcaacattgatgaaaaacggtacctgcacgaccaaccctgtttccatcgttgctggtttagaaccaccgctacttgtgttaccacgaatgccaggttctgtttctttaaccactaaatcaacagtctttggcaactcaattccaagcgtttcattaccatgcatgataattttgacattcatattttctttcaaataattcaattgatcgcggatctcgtcgccgggaagcgtcaattggtcataagtatcggtatccatgaagacataattgtccccatcggcatacaagtattgcatgttcttgctgtcaatttgcgccttttcaactttttcagttgagcggaacgttttttcttgaacggcacctgtacgcaggttcttaagggttgaacgcacgaaagcagaacccttacctggcttaacatgctgaaactcgacaattcgccaaaggtcaccgtcgacctcaatcgtcaaaccatttttaaaatcattaacagatatcatgaacttcctccatacattcagtcgtaaactaaacctattctagcaagcactgcgaatgcttgcaacagcagagcgtgagtcagcccggttagaaaccggaatgtaagcggccctgaacgtgatgaccgggccttggtcattgcgcacagggtccttacatgcaggtttctgggctgacgaacgcgtttcaatcagagcgtgagcaggcgcgtttagaaaccggagcataagcggcctgaagcctaaatggtcgggttttggccatttaggcttcaggtccttatgtgtaggtttctgcacctgcgaacgcgtttcagcaaaaattagcgagcttgccaatggtaatccagacgtaagcggccctgaacgtgatgaccgggccttggtcattgcgctcagggtccttacatgcaggtttctgggctgacgaacgcgttttagccaaaaatcaataagctaaccgatttgactcacaagtcagcttctggcacgtaacttacagcaccaacaactcactaggtgctggttgactcaagctttgactacccgcagcagtcactaataaatcgtcctcaatccgaacgccgccaagatccggtacataaataccaggctcatccgtgacaacattgcccttagcagccggcacgtctagatacggtccccaagcgccgggtccttcatgaattgacaaaccgatgccatggcctgttccgtggccaaagtacttcccataaccagcatcattgattgtgttgtgagctaagtcattgatgactcggccaagaacacctggttttaaagctttttgcactttttgattcgtttgatagacaatttgataaatggtcttcaacctaggatctggttcgcccaccgcaaacgtgcgggttaaatcagacatgtatccgtggtagatacacccccagtcaagcgtgacaatatcgcctttttcaattttcttctctgttgccgcaccatggggcatcgctgagcgcgtcccggaagcgacaatcgtttcaaaagaaacattgctggcgccaagtccgcgcatgaagaaatctaagtcattggcgacatcaatttcacgcatgcctggtttgatcgtagcaatgacatgttgatagcccttttcggcaatagcgatagcttgtgtgattaacgccaattcattggcatccttgatctcgcgttgcgtttcgacaaagtcacggattggtactaaagttccttgtgtgagcaaatcaaatgcttcataatcggcataatttaagtgaactgcttcaaaaccgattctagtcagttgcaagcgattggccagcttgccaacggccttaaacatgctgtcctgatgcaaaatcatttcggcattatgtacttgctgcttaaactgttcggtaaatcgcgaatcagtcataaaataagccttttgcggggttacaagcaaggtgctttcttcacctgtaaagccggtcaaataagtcacgttcttcgtatcggtaacaaaaaagccatccagttttttatcctgaattcgcgcctgcaatgctgtcattcgatccatccaaatcgctcctttactgactcatgctttgttttctctgaaaaaaagacgccccgttaccgggacgtctagtctttattcagcagctgctgccggataaactgaaaccttcttcttgtcacggccgaagcgttcaaattttacaacgccgtcagcagtcgcgaacaaggtatcatcgccgccgcgaccaacgttttcgccagggtgaatcttggtaccgcgctgacgatacaagatattgcctgccttaacgaattggccatcggcacgcttgctgcccaaacgccggccagcagaattacgaccgttggatgttgagccgccacctttatggtgagagaagaattgcagattcatctttaacataacgtacacctccgaggattaattttgttcaagttgtttagtagtaatcgtcaaacgatcaggatattggtcttggatgctctgtaattcgagcaataaattttccaacagaatctgactgatgtgtagctgttcgccggtaatggcggttttaattgccatctggagatgcccaccatggacttcatccgcaatgacatcaggttcaaaccctgctaagccttcaatgccgttaacggcaccaatgctcaccgcagaaacagcggcacatacaatatccttaccggttttaccggcatcggcatgacccgtcaacgagaagctgacgatatcaccatgttcatctcgatgaaaaattgccttgatcataactatgctgacctcttaagcgttgatcgcgtcaataacgaccttcgtgtatggttgacggtgacccttcttttgatgagagtgcttcttaggcttgtacttgtaagtaacaacctttttctcgcgcccttgtttttcgaccttgccagttacggtcgcgcctttgacggttggtgtgccaatcttggcgtcaccttcgcctgcaaccatgatgacttcatcaaaagtaacttgtttgccttcgtcagcgtcgagtttttcgacatagatggcttcgccaacctctgccttgtattgcttgccgccggttttgataattgcgtacactgtgtgcacctcctgttttgcctttcggcttttcccctgaagactcgccaagttgggtgcttacgcttaaaaacccaacattgtgcggttgcataggaggggtgccaaatacaacggactaatattaccagagacgacgtcaagttgcaagacaaacaacaagcgcgtagattggtgcgtttagaaaccggtatgtcacaagccgtgctgctttttaaacatgccaccttcaagactctcatatggatgtttctggcctagcgaacgcgtttcaaccaaaagttgaaagccacggcaccgccttcagtaatcacgttttaatctagaaaccatcaactgtgcctttttcgaaaaagccagacaccagcaatgactgccagcatgtaaaggatgtatatcatcgtaaagatggtcatccaaccaccaagtgcggcattaattaacagtaaactaatgactagaatagcatccacaatccaattgaccggttgagccaattgtgtggtcacaacgatcagcaaagcaccggtcacgagaagaattaaaaggttaagtaatataatgataagctgtcacctccttgaagaattatatacgagccatcttctttcaacaagaaatcgtttaattgagcaggacggcaaaagaaaaaggctcagaaaagatctccgagcctgcccctgccaaggacctttaatataccatagatgcgcgtaattattttactgaatttttgaattttggaggccgcattgtagccaacaaccccttacgctatcacttaaaacacgattgctgaaaagaaatggtttgttctaggaaaagcttccaaatattttgactcgtaagtctttgaaacgacggcacaaaaaaagccgctgattgttcagttcagcagcctttagttacttcttcaattgttgtaacgctttttcgatcgtgttgccttttccaatgtgtttggcattgcttgagtcaatagcgataaattcttgcgtcttcatgttgagttggattcgatatgacatcgtaatccctccattctttaaaaaatagtttgaatggtctcaggtagcgatgaaggttatactactcactttttgttagtatgtcaagcattaaaaaacacaatgattgctaactgacttgcttttgacgggataaatcaagatagcaacgctcaaaccggctttaactaatctgatttaaaagcaatttagccttcgttatggcctcgtcgtacgtgccatcggtcttggccggtaactttttgacttgatcaagcaattcgcgaccttgaatgactaatgcttcaatatcagcatttgtatcactcaaaaaagaaacagttaagtagatgtttaaggctttgatggcatcctgatcgcctaccattgcctctgcacctaactttttaatggccgttttcaaatttcggacttttctttgttcctctttacgcttgtgataataaggtaaaaacaaggcaacacaaacggcaagaaattcagatatacccgcaacccactctgaaattggacccatttccatcaataaacaccttcattgtcgtgactcatgtcaacatttcgaactaacaactcgtagatacaaaaaaagcctgatgcattgttctcctgcttagtcacgggtagtccgtcgtcacagcaatgcttcatggcatttgtaagttttatgtaccagccgggattcgaacccgggacaaacggtttagaagaccgttgctctatccaactgagctactggtacaaatcgttattaagtatacgagaagcgcgacaggccgtcaacgggttctatgaggaagatcatccgatacgcaagttagacggatatagttgaaagcagtcaatgagaccgctacactgaatttatcacaattttctcataaaggaagacaatgctgatgaaattaaatcaatttgcccgtttgacacctgacttcaaggtgcaagtagcggagcttaagcagattggcctgcaagccgatcctgatgacacttttagtcaaagtgcgaccgaccttttcaatgctttttttccagaggcttatactttagccgcaaagaaagataagctcgcccaagtagcagtcaacatggaccaaacactagcagcatggttggcgaaaaaaccatccaaaatgacgcgccgtgacttttataatgtggcgctacaactacttggcttcgaagctttcactgactttgacctgaatgatccatttaaaatgatgactgcaaccaagttaccaagcctcgatcacgatctaacgagcaccgctgatttgctcaaggctgtttatctattgttaaatacgcgaaccaagcatttggttagttatttggatgatctagctaatcgcggttttttaaaggacttccagaaaaaacagaaaaaaccgacccaccttctttttaacggcaaagtccaacaagtttttgatgcgcggcaggcggttcgtgaagttgtttggatcgaatcggatatggataccgatcacgatggccaacgggacttgctcgaagcgactatttaccgcccgaaagccacagatcaagggcttaaagtgcccgtgttatttactgcaaatccttattttcatggaaccaacgatgtgactgcagtgacgcacgtgccggaaacgaccttagctgttaaaacacacggagcctcgaaagctgaagttacggcaaatcctgaagagcctgccaacttgcctcatcatccagttaatggcgaggcgacacaggccgaggcttatgccgaagaaaacagtatgtatgcctttaacgattattttctcgcccgtggctttgctgtggtttattcggcaggtgttggcactcgctattccgacggctttcggacaaccggtggcccagaagaaaccgatggtgctgttgctgtcatcgagtggctaaccggtaaacgccgcgcttttacgaaccgaacagatggtattaccatcaaagcttggtggtcaaccggtcttgtcgctatgaccggcaaatcctacctggctaccttagccatggcggcggccacaactggggttgacggtctcaagacaattgttgccgacgctggcatttccagctggtatgactactaccgtgaaaatggtctcgtagtggcccctggtggtttccaaggtgaagatgcggatgttctggctgtggataccttctcccggcaaaagtctggcggcgacctgattaacatcaaacaagcttgggaaaagcatcttgctacgatcactcacgatcaggatcgaacaactggcgcttacaacacatggtgggatgcgcgcaactaccggaaaaacgctaacaaggtcaaggcagatgtggtgttgatccatggtcttaatgattggaacgtaaaacctacaaacgccatcaagttttgggaggccatcgcagacctgccaattcaaaagaaactggttttgcatcaaggccagcacgtttacgtccacaatgttcgctcattagattttctagatatgatgaatttgtggctcacacatgaattgcttggtgaggcgaatggcgccgaagatgttttaccaaatgttgttgtgcaagataatgttgctgttcagacttggtcggcctatcagaattttgccagcccagcagcagagcatgtgaccaacactcgcaatctaaaaacggatttcgaggcggccacggatcaatttaccgatcacgcaacagcaacttttaatgcccagcatgataccagtgccagtttcgagactgccatcatcacccctaacagtgcttatgccaatagccgcttgtggctcacgcagccgccacttgagcgcgaccaaacactggaaggcattccgcacttagagctaacgctggccattgatgccccaacaggtattctcagtgttcgcctcattgatttaggaatggccaagcgattcggtgagaccgcggcaacggtagccttaaacggtcttcaacttggttttgattataaaacaacagacattctcgaattcaaaccaacggctaaaccgacaccaagcaagttgatctcgcttggccatatcaacctgcaaaatccaaaaaatgcttacgaagtgcaaagtattacgcccggccaaccgttccatatcagtttggatctccaacccacccactatcatctgccagctggtcgtcaactcgctttggtcattcatggggcagatatggcccaaactattcgcccgatcaaaacaactcattatcaaattgatttggctaatagcagcatcactctcccttaccgcatttaacttaataagatgctcaccagtttttttcatgcataatgcatcaaaaaaggagatatcaaacgccgagtcggcctgacatctccttttttcttacttaactgttcaatcaacttgcttcaacggtgacagcaacagcttttgggttgtctggtttagtaaagctccagatattgttgccgttcccattcagaaacctgctgacgataagcggaccattcgaggttctttgagtccatgaaactttgatacaaatgtttacccagggcagccttgaccacatcatcagccgctaatgccttcaaagcattgtgcaaagttgatgggaggtcttgaatatgatttgctttccgttcatcgtcttgcatccgataaatgttgcgatcaacggcttcttccggcttcaatttcttagtcacaccatctaaaccggcttggagaatcccggcgatggctaagtatggattagcggttggatcaactgaccgcagttccagtcgcgtggacaatccacgagattgtggcacacgaatcaacggtgaccggttcttgcctgaccaagcaacataaactggcgcttcaaaaccaggaaccaaacgcttgtaggagttcacagttgggttattaatagcggttaaagcataagcgtgacgcagaaccccggcgagaaaatgcatggcagtttcgctcaactggtcatccgtattggcatcgaagaaagcattgcccttgtcatggaaaagactcatgttgatatgcatcccactaccgttaataccgtggagtggttttggcatgaaggttgcataaagcccatgcttgcgggcaatcgttttaaccacaagtttaaaggtttgaatgttgtcagcagcttctaaggcatcagcatacttgaagtcaatttcatgctggcctggcgcaacttcatggtgagaagcttcgacttcaaagcccattttttcgagttcaaggacgatatcacgccgacagttttcgcctaaatctaatggtgcaaaatcaaagtaggagcccttgtcgttcaactgagtcgtcggattgccattttcatccatcttaaacaggaagaattctggttctggtccaatattaaatgaagtaaaaccagcctccttcatttcgttcacgacccgaatcaagttattccgtggatcaccagcaaaaggactgccatcaggacgatgaacggagcagatcaaacgcgcaatcttaccgtgatcgttttcccaagggaacaataaccatgtgtcgagatccggaaacagtagcatatcactttcttcgatccggacaaagccatcaatcgaggagccatcaaaggtgatcttgttattgaggaccttctccaattgagaaattgggacctcaacgttcttaacgattccgttaatgtcagtgaacatcaggcgcaggaacaaaacattttcatccttaacagtctgacgaatctcatcagcggtaattgtttttcttgccatatacgtgaactcctatctttagtgtgattggcggaagcctatggctggaccgggatcgggactctggttcagtcgactctggtttaacaactcgtctcgcagtacttgccgcacttcggcatcgctgtcttcatgatgtcggggatgcttgagtcgctttacgtcggcaagcgtgaaaccgtctgccatttgactgcgaatctcaagcaattcattaacattattcagcgagtatgtccgatgattaccagcgtttcgtgcaggttgaaccaacccttgcgcttcataataacgaatctggcgcgcggttaaatcagtcaataacatgactgtaccaatcggcagaaccgatcgcgttctcagatcagcgatctcagccataggcatcctcctttacaacaatgtcaggttatcaaaccatataaggcgtgtcaacggcagatgtaagcttttctgacattcaaataaaaagataccctttttttgttttcaaaatgaagatgccatagaccaataaataaaaagacggtcatcatctctggtaacgcgcaaccgtttccaaccgctatgtcgctatcatcccaccaccaatcacatcatcacactgccggctcagactgttggcacgaatagaaggcatcgaagacacagtctttgaagtcactctaaaaattttccgtttaacattatgttaaaatcaactgaatctattttgaaaggaactcgcaggcatgcacttatatatcggctactcagaaaaagtagcagcaaggatactgcccaccaattggcgttgtttaactgcggcaccgttagctgcctttggcgcagcaatcatcgatgcctctgacactgcaacgctcactcagcttgtggccagccaattacccttaccaacttttatcatcggccagataccaatcagtcacactggtcagctgacagtcaccaacatcgatacacttaataccccaacgatggctcagattactgctgctgcacaagcttatgagcaaaccatggtaccagcattcattcgcgacttactggactatgcgaaggcggacccaaccagctttgcgactcctggccaccacagcggtcactacgacgacttagcaccagcaggttacttacttcatcaggcttacggcccaactttcttcgctagcgataccagcgatgtcgtcacttctttgggcgatatgttaacacatgggggcaccccgctagctgccgaagaagcgacagcgcagttatatcatgccgatgaaacttattttgtgaccaacggcacgactggatcgaataacattgtggccagtgcattgctcacgccaggcgatttggttttattcgatcggaataaccacaaatctttttataacgcggcactcgttcaaaatgatgcccgcccggtttatttggatacacttcgaacgaaacgtggtttgattggtccgatcgatttacagaatctaacccatgaaagtctgcgacaaatggccgtagcggtggctcccgaaaaggcacatcaatcgcggccatttcgactgacaattcttgaactagaaacctttgatggcattgtgccaaatgtccgtcagttaatcgatctttttgggcctttaaccgactacattgctttcgatgcagcttggggtggttatgagccgtttattccagcaatgacgaccatggatcccctgcaggtaccgcttgcgccgactgaccctggtatcatcgtcacccaaagtgtccacaaacagcaatccgggtttggccaggcatcacagattcataaaaaagatgcccatattaagggacaagcgcgatatgtcggtcacgaacagttcaaccacgcgtacttaaaacatgttacgaccagctacaattatccgctttacgcgtcattagtcgccaacactgccattaatcaaggtgctcgcggacaaaaaatctggcaagatgccattcgagcagcactcggctttcgccgctcgctcaacgattcgcgactcttttctgcttacgaaccgcctgagttgacaactttgcctgctgatcaggccattcagactgctgaggcttggtccatgacgccacaagctgcatggcatcaactcgcaggccttcaacctgatcaagcatttcttgatccaggtaaagtgaccgtgctattacccgacacagccgcatttggcatcagcggttggttagtagatcgttatttacttgaccacggcattattccggaaaaagccgacctaaatagcctgctttttttagtgacgccgggaaccgctcgaccagactggcaacgattgcgccaagtgttagcgcagtttgaagccgattattttgcaaataaaaccgttgctgaaagtttgccaaaattagtcgctgaaactggcgaggcgtatgcacatcaaacattacgcgaactaagtcagaccatgtcggactttttccgagaagcgcacctaactgagcaacaacgtgacttgtttaccaacaccaacgccatccccactgccatgaccccgcaagccgccgatcgttattttgttcgcggtcaaattgacaccatccctctggagcaagccacgggccgtatcgcagtcgacggcgcgctgccctatccgcccggaatctttgtggttgtccctggcgaacgctggcgaccggaagcgatcagttactttcaaacactttttgaaggtatacggcacttccccggctttaccccagaaatccaaggcgttaccgctcgtgcaggtggtcagccatatgttcatgttgttcatgaacaactttcatagccgtcaaaaaacgcgatcaattagcttgatcgcgtttttttgcttagcctattctagttatcaaagaaagtggactgcgcagctcccatggtcgccaatttaatatgcgcataggttaacccgccttgcaagtataacgtatacggcgggcgcaacgggccatcaccggaaaattcaatcgtagaaccagcaacgaatgtgccgcctgccataatgacttgatcctcataaccggccattttttccggaatcggcgtcacaaagctgtcaactggcgagtttgcttgaacagccttagcaaatttcaccatgtcatcggcattgccgaagttgactgtttgaatcaaatcggttcgcggtgcatcccaagcaggtgagacgtccagccccagtttagcaaacaaggctgcttcgaaaatggcgcctttaatggcattccctgtggtttgcggcgaaatgaagaagccttgatacatgtcagccaacgcatcgactgtggccccttcagccccgccaagacccggtaccgtgaaccgataactgatgcggtcaatcagatcctttttaccgacaatataaccgccagttttggccatgccaccgcctgcgtttttaaacaacgagccggccatgacatcagcaccgacttccaatggttccttggtttccgagaactcgccataggcattatcgacaaagatccagacattcggcaaaacactgcgaacaaccttgatcatcgcggcgatttgatcgacggtgaaagaatcgcgggttgcataaccgcgagatcgctgaatagcaaccactttggtcttatcgttcaaccgcgctttgacagcatcatcgtcaaccgccccgtttggcagcaggtcaacataatcaacaccaatgccatattcttgcggcgcgccaatcccgttgccagctaaacctagtacttcctgcaaagtatcgtacggcttaccggtgatgtacacaatatcgtcacctggccgaaccaaccctaataaggcaacgccaattgcatgcgtaccagaaacaaattgcggccgcaccagtgcatcctcgccgcctaaaacatcggcgtagatggcctccaagacatcgcggccttcatcattatgaccataaccggttgatccggttagataactttctgccacatgatggttttgaaaacttgttaaaaccttattctgattctccaagatgcgcgcatcaatttttgccagttgtggcgcgatctgtgcgtcaacttctttagccattgtctgtaattttggatcaaacttatccatccaactcatgatacttttctcctttaaatgagcgcgaacaggcgcgtttagaaatcggtgcatagatgggcgtcaaccagatttgttcgaagccgaacctagccaatctggttgacggccttcatatccaaattgatacgactgtattcgcgttaacgttgtttaagccactgttgcaccaacgtaacaatggcatttttgtcttccggatgcgcaaccagatcaaaccaatgggtcggcatctgattgcgaaaataggtcagctgccgtttagcaaaatgccgggaatgttgcttaatcagtgcaacagaatccgccaattcagcctgaccgtgaagatatggcactagctctttgtagccgatagcctgcatggcctgtgcatctgctggcacggtttttaatagctgctcaacttcagcgagtaacccggcctgcatcatcgcatccacccgtgcattaattcgatcatacaaaacggctcggtccgtggttaagccaatgaccaaggtcgagaacaacggcgctggttgtggctggtcagaaaagcgccgtccagttaattcaccgacttctaaggcacgaatcacccgccgcgtattggccggcgcaatttgttgcgcagcatctgggtcgcgctgtgccaattgctgccacaaccatgattgaccgtttgttgctagcgccacctgccagcgctgccgaatagctgtcggcggcgccttcccgcctaaaggcagatttaagcgcaaactattaagataaaaaccggtaccgcctaccagaatcggtaattgttgccgatcagccaccgtatcaatcatggccgtcgctgcctttttaaacttggcgaccgagtatgcgacggtagggtcagcgatatccaataaatggtgtggcaccccttgcatctcttctggcgtgattttcgccgttccaatgtccatgtggcgataaatctgataggcgtcgccgttaatcacttcaccgtgtagctgctgggctaaataaacgccgaggtcactttttccgacagctgtcggtccgacaatcatgacaatccgtttggctggtttatccatttcattaagctccgatagtatagtataataaaaacagtatcatagataattaatcaggggggattttcatgaaacataaatttgctcgtggcttttttgttggcacgctgatgacccttggcgcaattgccggtagcgtttttgcctttaagaaaaactatatcgaacctgtggaaactaaggtcgatgaaattaacgataaccggcgtaaagctaaccgtaagcgtttctcagcccatcaaggttaagcaacaccagctgttaatagcggtatgttcataatgagcgccgctatcagcaaaaaagcaatcgacaagttcgattgcttttttcttgcgtttatgtagcggctaatagttagtcgggctcttttttgttttgcctgaccagttatcatagccgccttttagccaactgattttttcgaaaccattcttgcgtaaacgccgagcagcacgcaaggagagcacgccagttttgtcatagagataaaccggcagatcttgacgcatttcacccatccgttcacgcaactgcgtataaggaatatcgcgggcaccgagaatatggcccgctttgaattcgttacgctcgcgtaagtcaataatctgtgctttacgcatggtatgttcaaagtcatcgggcgtgatctcgccgccgatagccttaaaccgtgatttttgatagtaactccacaaccaattgaaaccccaataaatcagaaacaatccaacaaaaattaacagataagttaacacgtgtatgactccttcttccgcttacttaagtgcaaggctggcagctccgataacgccagcagtgttacctagcgttgccagacgcagacttgttgtttcccgaacattcggaaacgtattttccttgaaatacttatcaactcgcttcagcaaaaagtcgcctgctgctgaaacgccgccaccaatgacgatgaatttcggattcagcagattgccgacatttgccaatgccaagccaagaaagtagctaacccggtcaacaatcatcaacgcaagtttgtcgccggttttggcaagatcaaaaacaattttgctagaaatctcatcgccatcatctaacgtctgcttcagtttggagtcgccagcgaattcttcagccatatcccgggccacccggacaacgccagtcgcactggctacagtttcgagacaaccgcgtttgccgcaagtacagagataaccattgaccggatcaacagttacgtgtccgagttcgcctgctgagcctgcaacaccatgcaataagttaccatcggcaataatgccgccgccaacgcctgtgccaagcgttacgaaagttacattggcgtcattttcgccagcgcctttccaacgttcgcccaaggcagcaacattggcgtcgttatcaatactaaagggaatcccagtaccagcctcaatatccttcttagcctgctgcaatgttttccaattcaagttgtaagcgccaattaccgtgcctgcttcaatatcaactgaaccaggtgagcccataccgataccgacaaaatcattcggtgtcatgttgtagagtttgagatgttcgttgatcgaatcaatgatatccggcaagatgtgactgccttcatccaaaatattagtatcgatactccagcgctgttgaatctcaccatcagtggttaagatcgcgaatttaaccgttgtgccgcccaaatcgacaccaattaattttttgtcattcatctttgtcattcctccgtttttcggcgggcagtggcagctcatgatttaaaggatgtgcctcttcttgcgcgtgtgcatgccgcagcacgacttttgcattcaggtaaaccttgtcatcaatgagctgcgctttgtgcagccgatctaattcaagtgcagccagttcgatatcccactcacgctttccaacatgaatgaacgtaccaaacccctttaataattgcagaacatcatagtaagttttcatactagcctgcgttaaatcctaagaaaagcaacgcgcccagtccgaagagcaaggtgacagctgaagcaatccgccgcggtgtccccatgcgaccaagtgccggagcacccaacatgcctgctgcaagaaagccaccaagcaaaccgccaatgtgaccaaaaatatcaatgccgctggaaaacagattaaacagtaagttcaagccaaccaacagtaagaattggcgcgccaactgacgaatcactggattttctttgaagctgtcgccgagcatcaagcaggcaccgagcaaaccgaaaattgctgtactggcacctgctgcaagtgtgttaggactaaaggcaaaactcgcgacattaccggcaaaacccgaaataaagtacaacagaaagaatcgccaatggccaaatagttgttccgtcatttgtcccaaataatacaatgagaaaccgttaaccagaatgtgcattaagccgatgtggacaaatactggtgtcatcaatcgccaccactgaccatacaaaatcaaaggattcagccgcgcgccgtagaaaaccaacacgctattattggtactgccaccagagaaagtctccaaaaggaagaccaaaatggtaaccgctaaaatagcattggtcacataagctgaattttgcagccgagagcgccagtttgaataattcatagtttcctttctaacccatctgccaagcagacaggaactgcttgccgtatgccgagcctgccgcaccaatccgctaaaaaaacaacaggtccgcctgttgtttttcgcaccgtcagaagcgttggccaaacacttggcggccatgttcttgtagtagtttagcattttttgcacacgctgccaacacgatcagccgttaactgtcttctgatgaatcgaataatccttatcttctttgatgttgttcatctgatagaagtcagtaaacatttctttggcaatctgcagttgataaggcgtggtggtttcagccttcagattcgggataatcactgcaatcgcaatctttggatccttcgctggtgcatacccaacgaaactttccgtgatggtttcagtgagcgctgaatctttggactcacgagcaaacccttgagcagtcccggttttcccggcaacgcccggattcaaagtattcagcgaagtcgctgtagtccaaccgtttgtgccatgcacaacctgccacattccttgcttaactaggttaatctgatcttgcgtattgtcgatttttgaagtaacggaaggctgagttgaggttaacaccggaccgctactgccatcgctcagtgtttggctaatactgttcactaggaatggtttcatccgataaccgttgttggcaatggcgctgatatactgcagcatctgaataagggtgtagttatcatagttcccgtaagacaaatccaacgccgaaccgacaagcaaattgcctgatgaatcatgcgtattgccttctaaccctgcaatctcaccgggcaagtcaatcccggttttgagacctaatccgaattggttaaagtagccgcgcattttgctaaaaatatccgaattcaatttcagataattatttggcgagtatgcatagtggccttctttcatggccagccacatcatgtaaatgttactggaaacttccagcgcagaggctgcatccaatgaactgaaggtaccgaccgggtaaacagatttcttgactggtgtaccaggcaagtaaatcggtgtatcagcttgagtattagaattgacggtaatcacgccgtcttgcaaggcgcctagcaccgtggcacccttaaccgctgacccaacaacaaatgcgcggttgataacgccaagtgcatcatcttcaaccttatgtgtctgaacatcctgatgctgacccgccatggcgaggatacgacccgtatttggatccatcgcaaccgcgtaagcaccgtctgacaagctgcccgcaccagcagatcgaatcgaactgaaggtgtcactcaaagacttttcgactttcttctgataatccgaatcgatcgtcagattcaaattggcgccttgttgccccttgaacttggaaacagattgaataatctggttgttattcccgatttcaacctgcgtttgactcttggaacccttcagaacattttcatatgccttttcaaggtaactggtgccgacccggtcattccgagcatagccatttgccaaatatgcctgtagttggtcagctggcaaccctgacttttcgttggaaacttgtccaatgattgacgtcatagagtcaccgttcggataagatcgctcccagtcagtcccaaggttcaccccaggcatctgcgtcaagcgctcaccgacaaccgcgacttcatgtgccgtcacgtcctgattcttaaggtagacagtcgatagctgagtggcgccattcataattttgtaaaggccagctgcttctttttgagtcgccgtaaaggttggcatgtgttgacgcacgtaagcgacctcatacttgtacaattcgtcagctttgtctgtcggcagatcttgaattttctttggcagtttggaaacaatctgttttgaaactttcgttggtgccaaatagtagtcaatataatcgcgcttggtaagattgtcttcaggcttgtcaataagcttggcaagctgattagcaatgtcatacatctgctgcgatttagccccaacactcttagtgtaagtgatggcattattcgccttattcgtcactagagcacggcccttgctatcaaaaataagcccacgaggcacattgccggtgaccactgttttgttggtgcgatcgacttcagcagccaaccgcgggccatttaaaatctgcaaataagccagctgtgcaactaaggctgccagcaggagaaacgcaatgaaaaataataaatttaagcgaaacggaatttgactcttgttccgtttgggttgcggtgtacgaatgtacttcacctaaaattgctccttcagaatttctatcttataaagtgtagcaaagaaccagtcaaaacgccatgacacgtgtcttatgatatgcttgaaatacggaagacgacacctaaaatgccggaattaatcttattttagaagttggtggacacttgtgcgacaacgttggttgaaaaattatccgctgatcctcagttttcttttaccgggactgctcgtcggcctttattttgcaatccgtggcacctttccatttggatcaagcagtgtgttgacagtggatctgggacagcaatatatcgatttcttcgcttacttgcggcaaaccttgctcggccatcctggccaacttttttatgccttcaataaagcacttggcggtgacatgtacggggtctttgcctactatttgcttagcccattcaactggctagttgtgttgtttccagcagatatgctggatgtcgctgccttcttaatcacggtgttgaaaatcagcaccatcggcttcaccatgggttggtacgctaaacgtcacgccatccacggcatgatgattccggcgtttgggttagcctatgctttgagtggctggctgttggccaacagctttaatttgatgtggctggatgctgcaatgctgctgccgctcattattgacagcgttgaaatactattcaaaggcggccgcgttatggcctatattggctggctcgccgcggctctcatcattaatttttatactggctatatgatcgccttgtttttaatcttgtatgccatttactggctcattgcccacacctccacatggcagcatttttggcgatccggactgcggtttgtcggcgccagcgggttagctgggatgatcagtgcggttgtgctattgcccacctggtttcaactgtcccagtcaaaaggcacttacaccgtggcgacgatacgctggcgctttgaatatgcgccaacaaggtttttgagtaaaatgctgccaggcagttttaactttgaccaaatgccatccggttatcccaactattacattggtgctttaggatttgtactggttgtcctctttttcctatccaaaagtcatccttggcgccaaaaattggcagcggctggcgtgacaattgtgttaatcctatcgtgcatgctagagccgcttgacttactgtggcacggctttcagtttccggtttggtatccataccggtttacatttgtattgtgcttctggtttttgagtctgggtatcgctgtcctgccgcatttacaaattggcattcctttgcaatggttaggcgttctgctgcttgtgttcggcgctatttacattgatgtcgctgccaacctcaaacacttcagctttctgaccgtgggccacttgctttttggcgcaggctgtctgctgctggcttttgtctggtttagtttggacaatcgccggccagtctggttcggttttgcgatcgtgttaattgacttaagtggcagtttaatcctgacgcttaatcaactagcctatttgaatcacagtgattaccacgattataccgccgccttgattcgcgggacacagaccatccagcaacatgatcccggcttgtttcgagttggaaaaaccaccattcgtacccgtaatgaccccatgacggccaattatctcggcgcagaccaatttaactccatgttagagccggctgtccccaaattcttcggtcagttaggacaacctgaagacgatggttcggtggcctacacaaatggcactttaattacggacagtctactaggcatgaaatattatctgacgccaaccaaacgggcggcaaaaaaactgccagatgccggtcaacgaccagatctaaagtggtatcggcggatcaaaacgacgcctacttggcaaatcttgggatcaccttttgcccaaaatctaggctttgtcgccgatactgatttgctcaaacaaccactctatagtgaaaccccgcttgccaatcagtccttaatcctgcaatcagccctcggcaagtcgggcaatccttattttacgccaacagcattagaggcaccgcaactcaccggtgtgcgccgagtctcaactggcagcgcacccacttatgctaaggttggtcagggtccccacgatgtcacttatcgatttaagccaataccaggtaaaatctatgtgttaaccctcggcagccagtttgctgaccatttagtgacactcaatcaaaatgggcaaactgtcaccttgccagatagttttaacgataccattacggtcaatgtcaccccccgtagtcctaaagctgaacaagttttgcggtttcgcctgaataaaaaagacgcctggtttgaaaattttagcttatatcaagctgacgccaagcaagttatccacgatcttaaaaaactgcaaacaggatcttggcatgtgatacaacacacggctaccaccgttgaagcgacgatcaacattttgcacgaccaccaaatgctgcaaaccacgatcccaaccgcctctggttggcacgtgaaagttgacaatcgacctgtcaccgtcaaaaaaagtttaggcattttcatggccatgccgctaaaacctgggcaacacgtgattaccatgcgttacgtcccgccattattagggtggggtgctgtgataacggtgactggcctatgcttaacggcttgttggtatgtcgttgataagcggtgcttctcgcgacaccttgtttcgcgacggtgagatatccgaagttatttgaccgaccattgcaacccaaaagccagtatccgcacgtctttgatcgtagccaattgattggccgttacaatcaaaaacgcaggtatactggctttttaaatgcgctaattcagacttgtccacaaactttttcaagcatgcctaatgccactatagccgagccataaaagacgcgctgggcattaaagcttgccgaaagcacgcttattcttctttaaattcatacttcggctcatccaagtgcgcatcatagtccactgtcatggcaagattttcaaagaaccatgcatcggttggatcaacaaaataagtgacgccgtctttttctactgccatgattggctggtcaggatgatcatcacgcgtcatgccaacactaaagccatcatgaacctgagtcttaccatatgccttcccaaaaaaacggataccagcacccttgtctggcaaacttaattcacggtgaaaccaacgacttgcttcatcagtgatcgcgagttgcaaccccatcatctccttgatcattttttacgagtccatgtttaagtgcataaatagctgcctgcgttcggtcctccacatccagtttcgccaaaatgttggacacatgcgtcttaacggtttttagcgtgataaaaagttctgtcgcaatttcttgattcgacttaccttgcgcgatcaattgcaatacctcacgttcacgattcgttaactcatcatactgtggttgcggatgattcatgcgattcatcattttagtcgtgacttgcggctccaaaactcgctcacctttagctgtttgccgaatcgccttggcaatttcctcggctgtggctgtcttgagaatgtaactggccgcccccgcctccatggctggatacaccttggcatcatcaataaaactcgtcaaaataataattcgtgcttgcggccatgccttcagaatctccttggttgccgtgatcccgtctttcaccggcatcacgagatccatcaaaataatatcaggccgatctttaagtgccatatcgacaccctcttgaccgttttcggcctgatcaaccacttccaaatcaggttgaacccctatgtaagttgccaaccccaaccgaaccatttcgtgatcatcaacaatcaatactttaatcatgcgcaacatcctttgataatggcaccctgacttcaacactggttccctgtccgaccacgctcaccactttcgcagttccgcccatggccgcggcacgttccttgatatttgcaagcccataattaccattactgctggcttgtttcgcatcaaatccgacaccgtcgtcgaccatccgcaacaccaccatatcctgcagctgtttcagataaacttcaaggctcgatgccttggcgtgtcgtaacgtgttacttaaaagttcttgaacaattctaaaaagattatcttcggccgctggattcaatttaatatcatccaactgccacgtgatctcgattgtaatcttggtttgcaattctttcaacaattgaataatcccttgtttcaaagatttgccttcaagattagtcggccgcaaatgcagcagcaatgcgcgcatttccgcctgtgcttcattgatcaccttttggatcgtatccagttgtttgctcaggtcagcctgcgcagggtcacgattagccacactacgcagtgcagataacatcatcatcgcagcaaataactgttgtgagacagagtcgtgcagttcacgagcaagccgatgccgttcaccggttaaaatggcttcttttgtttcaccggaaaatcgaaccggcgtgttgctataccgttcaatctcacgttgtaagcgtatcattttttgccgcaactcttcaagcaaggctgccggttgtttacccaaagcgccgactgcctgctgcgagcgactaaaaataggtgcctgatattgtccagcgtttaattgtgccaatcggctgtccaactgactgtgcatgactcgctgccgccacatgacaataaccgtcgcaccggtactgatcaacaaagcgccgattaccagataaaccaaaaccggcgcggacaggacggtggtcaataacacctgcaaaaaatcatgttcggttactttagctagcatgaaaaccaaacaggcctcgaccaaaagcgcccagaccagtaatgccataaaaaagccaaccagcatccgtcttctcatacagccagcacctccaaatcgccgacacccacactcgtaatgatgtgaatgcggcgcggtgcatcatcatagtcctttgaatatgccgtgacactttggctatgcagcatcgaatctttattttcaaaatgcaaggtaccataaaaggcagcgtgttcaaccgcaacaccaacgccaatcggcaccagaattcgcgttttgccaaaacctttgcgaatcatgatcacactatcgcctttaggtagaaacgtatcccctaaatcaataatggtatcgccagctggcacaaccatattaatgtcatcccaatcataggttggcgaaatcgtatgccgatcagtccacgagttaatcgtgcgcttaccggctttttcactgggctcctgagtcactggcgctacatactgtttgcgatcccaagccgaaaaccccatacctggtttcgtaacgaccatgattatgaacacacccgcgatcattagaatgagccaaatggccggattgataaaaattcccaagactaacaaaatcccgccaaaagccacattgaacgagcgcaaccgatgccatcgcgcaccgaggaaaagaaaaaacacgcccactaggatcgttgtcagtgccataggattcgtgatgatctggaaaaacagccacagggttaaagctaactcgatgcctaaaaataattgccagcggcgcacgacgatccctccttgtctactttttagcgtatacattgactcgatgtcgattcatttcaattaattataacgaatttcgttgcctttgacttagggcgtaaggctgaatttgcaacccaagatgtggctcagtcgccgtttcacttttttaaagccacaaaaaacgacaaacgtcttctccttgatgaccggaaaagacatttgccgttgattgcttttggcgcaagttgacaaagcgttatgtgctgatcagccttcaactttggtgatcttgatcttcatctcaccaccaggggtactgatcgtgaccttatcgcccactttacggccaatcagaccttgagcgatcgggctttcgttgctaattttaccgttgaaggcgtctgcctcagcagcgccgacgatttcatatgtttcttcatcaccgtcttcttcaaacgtgactttcttaccaagtgatacttcgttcttagcaaccgcttttgaatcaataatttcagcgtaacgaagcattgtttgaatggtcacgatccgattttccaaggtggattgttcatccttagctgcttcatattcagagttctctgaaagatcaccaaaaccgcgagcaaccttgatccggtcgataacttctggacgcttctttgtcttcagttcctccaactcgtcttcgagtttctttttgccttccgctgtcattggatagcttttgtctgccataaaattcttacctcacttcttattttccttagtcactgtattaagaccagccgcatttgtcaatgattactcttgcaaaccgcgttcggccagaatggctttgatcttagtaaccagtaaatcaatggcgacttgattttggccaccttcaggcacaatcaagtcagcataacgcttcgatggttcgacaaactgatgatacatcggttttaccgtttttaaatattgattaataatcgaatccagtgaacgcccacgcgataccatgtcccgcttgatgcggcggatgacccgaatatcatcatcagtatcgacaaacaccttaatatccatcatgtcgcgtaattctgcgtcatcaagaatcagaataccttcaagaataatcacatcttttggcgccagatgaacggttcggtcagagcgattatgaatcgtgtaatcatacaccggttgatcgacagcttgccgatggatcaaccgatttaagtgatcctttaacaatggtgtatcaaatgccagaggatggtcatagttaatcttttttcgttctgaaaacggcatgtcacttttcttgtaataagcatcttgcgctaataaaagcaatgagtgccccgaaaaatgatcaaaaatcgctcgactcacactcgtcttgccgctggcagaaccacctgtcacgccaatcacaatcggttttttctgctgcaccttgaagccctcctcaaaactcatccttcagcccagaaacaaccgcataaggaccctggtcacaatgaccaaggtccttatgcggccaaagtccaattaggttacttatctgccgctgcattatcgctggcaaacttagccgtattggcatcatgttgttcccgtgttgtcgcgtaaagtacttcaccagttttaaggttagcaacaaagtacaagtagtccttgtcacgtgcatcagggctgagaaccgctgtgatactttgctcacttggcgagtcaaacggtcccggtccatagccggtgtggacgtataagttgtacggtgaatcaacgctagtatccttgttagtcagatgcgttttatgcgtgttcaatgcatacataacagagatatccgattgtagtggcatccccgcatcaattcggttcaagaagacaccagctattttgcgacgatcatcttgggtgaccccttcacgctcaactaacgatgcaagcgtcatgacttcttgaacggtgtattgctgcttcttaatgctcttgtagtaactttgcatcacactgtctgtcttggcaaccatcgcatccacaaggtccttgactgtttcaccagcgccaacgttataagtcgcagggaaaagatagccttccaatcgatagcgaactccttttgcattggccgctgaactcagcaattgcggatatttcttagccaattgattaaagaaggtttgatctttcatcaatgccagaaatttctttccggtcagatttttgttgcttttcgttaacttatccatcgacgtcgcgatttgttcgatcgttgtgccttctttaactagcaattggcccgcagcagtggtggcactgccacccgcgcgcaaggcttgaatcaccgtgctcatattggcgcgttgtgtcaacttgtactggcccgcctgaaagtcggcgatattgtggaatttcacatagtaactaaaaacagtggcgctcttaatgacatgtttggcttccagctgcgcggcaatctgtttcgttgacgaacccgctggcaccgtcacactaatcgacgtcttgccatttggatcaaccggctcaagcgctgaacggacatagcggtagcccatcaaaccaacgatcactaggaccgccaatacaatcccaataacccaagcaacgatcttgttggctactttcttttcactagaacgctggcgccgcttgtcttgtcgatctgatgaccgtctatccaaaaatgttgcctcctctaaggttaacacggtcactggcacagaaatctgcacttaaggacctcgtccacaatggccaaagtaccggccatcgtgcccaaggctgcctatgtgacggtttccaaacgtacctagtcccgctctacttaactattctgaacaataaatctgaatcagcaaatattatacccaaccagcgacaaaaatgcgactgcatctagcgaatggcagccccgattcctgtctgtaacgccgccttcactttatcaaacgcctgcgtcacttcgtcttcagtcaacgtctgatcgtctcgacgataagttagcgtatacgccaaactcttctgacccgcggcaatgtgatcgcctgcataaacatcaaacaacgtcacatcctgcaagaaggcaccgccgtgttcatggaaaatagccatgacttgatcgttcgttacttgctcgtcaacttgcaaagcaatatcacgggttactgccgggaacttcggtgcgggttgcgcgattttttcctgtcgcggtgcggcaaatagcgcatccaaatctaattcaaaaacaaaggtggctggcaggtgctctgcatgttcaaaggcaggatgcaagcgccccaaaatgccaacaagttgatcgccgacaaaaatgtttgcggcctgaccaggatggagttcagcaacagcttgcgttgcttcaaagcgaatcggattggccagcgaataatcatccagcaaatgtgtcacaatgcccttagcgtaaaagaaatcaacggctttcgcagattgatgccaatcttttgcgacaacattgccagtgatggcaccacccaaatattcaatttcggttggccgcacctgatcgcctgttttggtaaagatccgaccttgttcataaatcgcaacatcggtttccttccgcgcttgattatacttgatgacatttagcaaaccactaatcatgttcatccgcaaaacagcatgatcggtcgtcatcggtgaatcgactttggttgggaccccaggttgcagcttgaattgctcggcagcctcggcagttgtcaacgcataggtgatgacttgggtcaggcccaatccttctaatagatgacgtgtacgtcggatccgtttttgttgcgaggtgtactcgccaatagtcatggttgtcgttggtaacgtacttggcaaattgtcaaacccatagattcgcgcaacttcttccaccaaatccgctttgatatgaatatcccaccggcgcggcggtacagcgacggcaaacaagccatcagattcggtcacatcaaaaccgagttgttcaaaaatctgcgtcacttgttgctccgtcaaatcggtacctaaaacatggttgatatgatcaagcgaaatatcgacgacaacatcttctgcagaaactgaagtcgggctgaccgttccctttgcaacctggccctcgcttaattcagccatccaagcaactgcagcatctaaagcacgattgatatcagccaagttcgtccctttttcaaatcgggaagaggcttcagaccgtaaattgtacttaagggctgttttacggacattgactggattaaaactagcagactcaatcacaacggtagtcgtttctggcgtaatttcagagttcaggccgcccatgacgccagccaaagcaactggtacctgcccattcgtaatcacaatatcttgatcatctaattcatgttcattgccatccagcgtggtcaaaggttcgccatttttagcgcgccgcaccacaatctgctggctgcctaacttggcatagtcaaaagcgtgcagcggttgcccataagccagcataataagattggtcacatcaacaatattattaattggacggatacctgctaaccacaggcgtttttgcaaccacaaaggactttcttgaaccttcacatgatcaatgacccgcagttgataactcggagcgtctttggcatccttgacctcggcactcaaaaagtcgccgaccggacgatcaccttcagttaatagcttttcttcaaaatggggcttttctgcataagtagcgccaacttcccaagctacgccccgcatgccaagtgcatcagcgcgattaggcgtgatctcaaagtccaaaatggcgtcatgcatgcctaacgcagctaaggcatcactgccgggctctaatggctcgttaaagacatagataccattcaaatatggtttcggcacgacgttttcactaaaaccaatttcctgtaaggcacaaatcatgccaaggctttcttcaccgcgcattttgccttttttaattttaacgttatccgcaatgcgcgcgcctggcagcgccacaatgacagtttgaccggcagcaacatttggcgcgccgcagacaatttggcgcggcgtttcttcaccgacgtcaacttgacaaagatgtaaatgatcagcgttcggatgtggcgtagcacttaccactttaccgacgacaatctttttcaagccggcgtctggatgcttcacgccatcaacttcaatccctgttcgtgacactttatcggccagttcttctggtgaaaccggcacgtcaactaattcttttaaccattcatatgagacgtccatcttaaccctcctggctgaattgcgttaagaagcgcaagtcgtctgtgtagaaactgcgaatgtcgtcaatcccgtatttcagcatcgcgaaccgatcaggaccaaggccaaaagcaaaaccgccgtatacgtcagcatcaatgttcgctgcccgtagcacattgggatgcaccatgccggcacctaacacttcaatccaaccggtatatttgcaaaccgggcaacctttaccgccgcaacgaaaacaggaaacatcaacttcaacggatggctccgtaaatggaaaataacttggccgcaagcgaattgtccgatctttaccaaaaacgtgttggcacatggccaacaaggttccctttagatcagccatggttatatgcttgtcaatgacgagtccttccatctggtgaaactgatggctatgagtagcatcgtcgtcatcacgtcgataaaccaccccagggctaatcattttcagcggtcctttggtaaagtcgtgcttttccattgtccgcgcctgcattggacttgtctgcgagcgcatgagtaactcattggtaatgtaaaaagtctcttgcatatcacgagcaggatgatccttagggatgttcatcatctcaaagttatagtgatcttcttcaacttctggaccggtcaaaacttggtaacccatgcccataaaaaagccttcaagatcgtccataatctttgtgataatatgtggtgtgccagcctcaaccggatcaccaggcaaggtcacatcaacggtctctgatgctaatttcgcattgatcaccgcctgttcgagctgggctttgcgggcttcaatcactgcactgagatcgtcgcgaattttgttggcgaacgcgccgacttttggccgttcttcagcggacaaatctttcatgccgcgcaaaacaccggtaatcgggcccttcttgcccaataattggacgcgaatctgatttaattcatctaacgacttaacctttttaatggtgtcgttgttttgttggaacaattgttcaagtttggtttgaagatccatgttcttcctccttggttgctgacgtgagggttgatacaactttctgatgcatttgaaggcataaaaaaagtccctctcgaaaaagggacgaagcatcgcggtaccacccttgttcatggtcacgaaataaccatgcactcaacaaggtaacggctaggccggagctttctaagtgttgccacttcaaaagtcaactcagaaagtgaagacaaacattttggcgatagacgtcttgcagtcgtatgaacgtcattccctatctcgtcagcctgtttgggctttcgtcatcgtttttacgtctttttagataaactaagcttagcaaattcagcgccaacgtcaagtggcgattcgcgctagttaataaaaaatgtggtgtcatcacgctccctatgacttgtcgtttgctagactccgagtaagctttgaaaggaactagacgatgcagtccctaacctcggccgtgccaaactccgcaatctccggccagacggggctggaacgctgtgacggcgcttcgagcccgcaaagcccgcggtctcgaagtcgcctaacaacatcagcgacaagaccggtcgctgtgttgtttgcacggctgagccccatctggcctacgattgctccgccttagcactggaattttgaaatcctgtatcaaattgtctatgagaaacgaaagacgaataattttccgcatttggaaaaccattcgtctgcatttgatacgtttggattatgctgaatccctacttctcgttagcgtggcattcagcatctgtgacccatgcatcgccccatgcgtgtgcagcggccataactgaattgaggccgcggcctttgtcagttaacgcgtattcaatcaaagctgagtctttgtgggtcaagcgatccacaaggccttcgccttcgagttcctttaagcgttcgaccaagacccgatcggaacaccgcgggattaattgcgcaatgtccttaaaacgggaattgccattgtttaataaaacttccaaaatcagtccgttccatttctttcctaagatctcaaacgtatgttgaaattttggacaaagagcgacctgctggctttgacaatcggctgtactggttactgttgcatccactctactcacctcataattcccattcacttacatttatatagtgctagaataccacaatgtgaaaatattacaagccagtcctcgagaaacgttgaaaaatatggcaaaactttccagaaaaagaaccacggcattcatccgtggttccaatcgtccttcacagccaaatagctgctaaaactttgcgatcctaatttaaagcctttaagtgagtgtggatcggatgccggagcttgtgcatccatggtacaacgacttcatccatggcggcataatcatcgacaagtgaaacaacgaaactttccttatactttggtaagccaaccgttgcgccccacatgtgtttgacgataatgtctttttccatcggtgacaattcagtcagcttttcagcattccgcaaagcaatccgtggatggatgaaggcatgagtccccaagtcaaacttggttttacgccaatcgtagtaaaacaggtcgtgcaacaagcctgcccgggcgatcgcacgaacattcaagtgcagccgtttcccaatcagataactctggtaagaaacactgatcgagtgttccaatcggttagaataatgatgttgcgggtgttctgccagtcgctggacttcgggtttggctaaaagatccgccacatacccaacgtactcagcatccgattgccaatcgcgttttttgctcaagacatctgctccttttgtggtttgatgaacacacttatagtataacaggttctaaccagaaaggtcacgtttgtaagggattcttaatccccgactaaatgaaacatcatgactgctgcagcaaccgccacattcaatgattcagctttgccccggatcggaatgtaaaggttcgtatcggtattttgtaacaaaactggatccatgccattgccttcattgcccacaattaaggcaaatcgttcgctcggttgaatgctatgataacttttagctttttcatttaattctgagccataaactgggatgccgccacggtgtaaggctttgataattggcattaatttagcggagacaatgcgcacatggaattgactgccttgcatcgcacgtaatacttttggaccgaacgcatccgctgtcccgttaccgaagaccaccgtttgaatcccagctgcatctgcagttcgcaccaaggtcccaacgttacccgggtcctgaatcgcatccaacaataagaactgaccactcaatggctctggcaattgttctgcgcggcgcggcatcacagcaaaaatgccttgcggggtctgagtgtcgcttaaatgctcagaaacggattcagaaatctgtgtgattttgtcataaaatggcttgagcgcacgatcttcaacatacttttcggtcgcataaatatcataaggggtctggccactggcaagtgcctcttggaccaagtgacggccttctaataagtagcggccagcatccttttgatgttttttaaccgtgagtttcttggctgttttgattctgtcattcttaggtgatgaaatatattccatgaagttctccttatttttaaatggtactttgtttgcttgatgccgtttggcgggttttcttcttgcaagacaaaatccaacttaagtctgttgtcgtttctactataagccttatgctacactagtatggactgtggagaaagttaagatgagcaaatgctgcttgacagcatctccaattaagaaaggaagtgtctttttggtcaaacttgctaaacaaatcgtcgtccgcggacgggtgcaaggcgtcggtttccgctgggccacgaagatgatcgccgacaatcttgatattagcggcacgattgagaatcggtctgatggctctgtctttattcaggctgcaggtgaaccgttaaaccttgccaaatttgtggcgaaggttaaggccggtccaaacccatacgcaaacgtgtcgacctacgaagaacagccgcttgaagacgtgccaaacttccgcggttttcaagttaccggttgaatccaaccagtccatacagtatagttaaacccgattacattttgaagggaaaacattcatgcacaagtcaaaaaaatttgtcacacttgggttggtgagcttgctgccgttgattttagcagcatgcgcgcaaaccactaaaaaaggcacaaccatgaagccgccgacggatccgttttttggcactttttataaagtgatcgggctgccactgcaacatttgatggagtggatcgccagtctggttggcactgccagcagttatgggatcgccatcatcgtgatcaccctgctagttcgtctgattgtcctgccactgatgctgcggcaacaacgaacgatgacggcttatcaagagaagcagaagatcatccagccacaactaaagatcgttcaagaggctactaagcgcgccaagacacctgaacagcagatggcaatgaacggttacatgcggaaaatatactcagccaatggcacaagcatgattccttccatgggctgcctaccaatgctgattcaactgccaattttctctggtttgtatcaagccatcgcttactccccagaaatttctgaagccactttttttggcattcagttggggcattccaattttattgtcacgattttagcaactttgccatacattgtcgtcagcttgatcatgctgcaaggcgtaccgccagaacagcgtaaagccatgcagacaactgcctttctgaatccgatcatgacatttgtcttttgtatgatgtacaacgccggattaggcctctacttcggtgctggcgggatcattctaattatccaacaagcgatcgtaacctatgttgttacgccgaacatccggaagcgaatggatgctgaaatggaagaaaatccaccggttatcgttgttgacgaacatacttttgataactgggatacggcaactgctggtgccactggtgcagctggtacaacaggtagcagcaaacctgctgatcccgacgccattgatcatagcaaattacgtcggcgtaacgctggtaaacaacagcgtccccggaaataatcgtcaagttatgaatagccctgatcgcaaagcttgcgattagggctatttgtgtgcgcgacaggatctgaagccaaaagtatttgatgtccccctgtttgttcgcctcatacagtgtgggttgcttgatgacacgctcatatgaactcaccctgcgcttgaaatcaaaaaaacctcagacaaatagctcgtctgaggtataaaacgattaaagattactcttgatatgtgtatcagttttgcctgcttctgcgcgcttagtggtttcctgtgcagccagtgcttgggctttagcttccgtgatggttggtaaatcaattcggaaaatggatccatgacctaaagcggagtcaacttcaatttgaccgtgataactctcaactaactgttgcgcgattgataaacctagtccgttgccgcctttttcacgactacgagccttatcaactcgataaaaacgattaaagacgcgtcgacgatccgcttcggcaataccttcaccaaagtcttgcaccgcaacggcgacaccggaaacgctgttttcagccattgatacgtgaatctccttgcgatcagtggaatacttgaccgcattgtccaataaaataatcatgacctgttccaaatgattgcgatacatgcgcacaaacgttttctgttccaagtcgtcatctaatgtaaacgtgaattccggatgaatcatccgaaaatcaccaacgacttgttgcacagtctggtgcacatcaacaaccgcatttggaaattggatatccacttgatcagcgcgagtaagatctagcatttcttgaatcagactcttcatgcgagtcacttcttgcaatgaggccgttaaagattccgccaaaacttccggatcatcttttccccagcgatttaaaagctgcaaatgcccttcgagaatcgccacaggggtgcgcaattcgtgggaaacatcctgaacaaactcaccttgctgatcaatgtagcgttgaatccgatccaacataccattaaattccagcactaaatcgccaagctcgtcgttgcgcttcaaggctggtattcgaaccgtactctgcggttcctcattgacaacatcaatagcattcgtaataagcttaatcggcttgagaaagcgcgtcgccaaagcatagccaatgagaatagaaataagaatagccgcaaatgacagtcccataatgagtaacgtaatctcatgcatggtcgcatgaaatgccgtcagtttatccgttacctgcacatagccgatcaaatccgaactagttacagaataaatcggtgccgtaccgaccaagccatgaaaatcatcaatgttggcttcttgaacttccacgccatgaaccttgcctaatgtaatcggcgtatcgcgcgattgaaaaatgtttgtccgatcaggtgaaaaaacagagacgctcacatccgcttgcgctagtttttgaatcacggagtcggagaaaatacgattttgcgattcacttggcgctggaatagaggcttgcccactcggcattgcaccttccaatcgcggcacgacctgcgccatcgttaagtcaccactgactggggaaagtcgttggacgacggtgttaagggtgtccgtcacggttcggcgttcctgattcactaaaatctgccgcatcgcgccataaaggatcattgaaaaggtcacaaaggtcacaaaaatcccgacacctactgttaaggcccatttaacctttaacgagatgcggggactttttctagtttgctcaagcgtttgtttcttcggaatcattacgaacgcataacatagccggttccccgaaccgtttgaatataactcggttcacccggtcgatcgattttattacgaatataacggacatagacgtcaacaacattcgtttccacgtcagagttgtaaccccaaacctttgagagcaaaacgtcacgagccaaaacaacattgacattttccataagcgtcagcaataattcgtactcacgtttggttaattcaataatgtcgtcgccgcgccgaacaacgcgattttctttttcaatcactaaatcacgatatttgatggttgtctgcttagcagtgttgttttcgccttcaatgctgattcggcgcaacaaagcacgcaagcgagcgagtaattcttcaatggcaaatggcttcacaatgtagtcatcagcgccatgatccaagccactgacgcgatcaatgacagaatcccgcgcggtcatcataatgatcggtgtattcttcacctgacgaacgcgccggcaaacttcaaggccgtttaattctggcaacatcaagtcaagcaagatggcatcccagtcctcagccaaagccgcttccaacccggttcgaccgttaaaatgcacttcggtctcatagccctcgtgttttaattccagttcgacaaaccgcgctaaatttttttcatcttcaataattaatattttactcatcaatggtctccttatacttattcgtctctgacgcactcacagactgaatccatttgttttttctcataaaaacatatgctacgacagtttagcacagttttctcattttgactatcagccgcgcaacgatggggctcgacaaacacaagaaatctttgttcggagactttctcatttttcaaaactggtaaattctcataaaaagaccaatccttcaaacaataaatatgtttgtgagattggtcttcatttttataaatatgaagttattaagcttcggtataccatgaatagtggtagatgccgtcgcgatcggttcgttcgtaagtgtgcgcaccgaagtaatcacgttgtgcctgcgtgaggttagcaggcaagacggctgaacggtaggaatcgtaataactgatagcggctgagaagcctggaactggtacaccagccttgacagcaacaccaactaagtcgcggacactttcctgataattcttggcgatattcaagaagtagtcatccagcaataagttctgcaaatcgagcttcttgttatatgcgtcagtgatgttttgcaagaaacgagcgcggatgatgcagccagcgcgccagatcttggccaagtccccatattgcagtttccaatcgtacttctctgaagcaaagcgcaattgttcgaacccttgggcatatgacatgagcttactgaagtacagagccttgcggatcatttcaatggcttcttttttgtcaacagaaacattggcaaccggcttcggcaataccttgctggcctcaacccgttcttgtttcatggcactgatataacgagcgtagactgattcagtaatgacactctgcggtacccctaattcaagtgctgactgggaggaccacttgcctgtgcctttattgccggcacgatcaaggatcatgtcaacaatcggtttgtcactgccgagatcatccttgcgagtcaaaatgtcagcagtgatgtcaatcaggtaagaatccagttcgcctttgttccattcactgaaaatatcagccatttctttgacatcaaggccaagaagattgcgcattaagttgtagctttcagcgatcagttccatatcgccgtattcaatgccattatgcaccatcttgacatagtgtcctgctccgtttggtccgatatacgtgacacaaggtgcgccgtcttcagccttagcggagatggcttccagaattggtgcgaccaggtcataggcttctttttggccgcctggcatcaatgaagggccatgcaaagcgcctaactcgccaccggaaacacccatgccgataaagttaatgcctgacttgtcgagctcagcactgcggcgcatggtatcttcaaagaaagtattaccgccatcaatcagcacatcgcctttatccaataacgggagtagttccttaataacagcatctgtaccagcgccagccttaaccatcatgataattcggcgtggtttctcaagtgatgcgacaaaatcttcaattttgtaacttggtaccaactttttatccggatgctcttcaacaaccgcctttgttttgctgccagtgcgattgaagatagcaacggtattgccgcggctttcaatattcagggcaagattcttgcccataactgccatgccgacaacaccaatttgtggtttatccattaacatggacctcctcattcatttcgtcatttactccttttatgttagcagaaacggcttgggtttaacagtcaacagctaggttagaaacggtcaatttttcttcgcttattttctttgaaaaagaagacgccgcctcaggcaaacagacaaaatttgctttgtttcaactattttaaaatgctatccctctgtgtgagctgttatcacggtgaaactgttagcattaattgtcacgatgatgtgatcaatcttgacgtaccaatttttaccctttcgattcatgattgcttcaggattcagaattttctctttgcaaaatgcaatgacgtcccgattagtaagtgaaagattgtgttcaatccggatgcgccctagttttgtagtgtgcaatttgtctaagtttctcagtaacggattatcagaaatcatttttatattcaccgcagcgaggctttactttttgagcccgctccctcatcaactgtttttgagtcatgaacccaacaagactttctcataaaaatcgttttcgctactacaaaagaaaatggcatcctcgcaatacaattacgaaggtgccatttttcaatagatcaaatcgccttaccgtgagccagaagaccttactgatcacgcttgatcgtcatcagggaacattccctttaatttcgtaaagggattgtccgcctgtttttcttttttaacagctttatcaaaatcctcttctgctaaaacttcccaatcatcgcctgagggcatatcaccgcttgcgacttcttctggtgtcaggacctgcattggaatgctcaacaacagatggtcctcaatcgctggcaacagatccagttcagcatcttcgagcggcataagaatttcgccgtcctcatattggtcagcatgaccagcgtccgttaaataaatttcgctgaacgtaaaatcttgcggcagtgtgaccggcgtcaaactgcgcgttgacggcacaaccaaattaccctttagattaacactgaccaaaaagtcaccacgatcatagacaatatcgccgcttacctgaatgggactcacgtcgagaacctcgggatcgcgatcctgtaaatccgttttaacatctaacgtagtgctaaaatgcaacggctcctgatcgtgttttattaactcctgaacggtccatttcaacatgtggtttacctcctttaaacgcgttcctaggcgcagaaacctgcacataaggacctcaggcgctatggccaaagttcggtcatcacacctgaggccgcttatgctccggttactaagcgcgccagttcgcgctcttcacatcagtggtcgtcggccatagttctgctcaacgccaccaatcgttgtgattaatcgatccgcgcgatgggtcatcgcgaggacgccatccggtgcaagcatatcagcactgacctttgtgagcaagggccagtcaagatcatgcttgacactattgagatactgccgcccagttggcgtgaaccctaaaacatgcaactgcgggtgttgccgtgcctgattaaccgccgtagccgtcatattcaaagtaatggccaacgctagccgtcgcaaccgcgcataggtatagcgtttcgattttacctgcttcaaaaaagcagtcatgtcttgcgcgtcatcaattttttgggtgaagcgatactctaacccttctgccatggttgcgaccagccgcagttcattgagctcggctgtttgcaggcgatatttcaaccacgggaaaaattgtgcccagctatactgttgttgcttagcataaaaatcgacaagctcagtaggcacaatggcttcaaccgattgatcagcacgtaaatactcacgcactgtcgaggcgctggcgatgttggcttgaatgcccacttcatcatgaccaatcccacgacgcgcaaatggtaacaatgtcatcggccacttcaacgccaaattagccttggcataactcaagcccagcataaaattaggatcagtttgggtgatcccagccgcttttgcataaacagcgttgagttgcgtggcgtatgtctgcgtataatcgcgaaatccatccccagttaacgctgctgtcgccagtttttcagctaaatctgcataagcaacttcaggatgctcagtaccaaaggctaaagtgttgacacccatggcggccaacgcggtcacaccggcttcagcaaactggtcagcggcctgaacggctccggtcaccggcaactcaacgacaaggtctgcaccatgctgcaaagccgcctgtgcccgaacccatttatcaaaaatagccggctccccgcgttgtacatagttaccagacatcacgacaacgacaacatctgcttgtgccagctttcgcgcttgtgccaaggcatatgcatgacccgtatgaaatggattaaattcagcaatcatcccaactgtctgcatggccgcctcctaaactgcaaaatcatcatggtcattcattttttcttcgcatggaaaaaccagcgtgtgctgtccgcctgaattggctgacggccaaaatcagctgtcacttcaattttttcaaacccacttgcggttaaggcatcgagatagtcgttaatcggataagttcgttctttatgggtttccgtaagcggcttataggcatctaggccctcatcataaagaaagaacgttaaatcatgctcaacactatgcggcacctcacctacgaaactgtgccataaaaaggcaaaatcatcggtctgataattgtacatataaccgggaaaaatctgatccatttgatataacgagtgcgcatcgaaaagaaagtccccgcccgacggcaacaaagacgctacctgagtgaagacttgctgaacttcttcaagattcgccatataacaaatggagtcgtcaaaacatgtcacgaccggaaccggtggtaaatcactcaaatcacgcatgtcgccttgaataagagtcagttgggcatcggcttcctcagccttttctgccgccagcgacaacatttcgtccgataaatcaaagtcggtcacctgatagccggcttgcgccaaaagaacagccaagaaacccgaaccgcctgccaactccaagataggctgaccagctggtgcaacccgcttcgtgacataatcccgccactgcgaatagagtgattgatccatcagtttgtcgtaaacttcggcaaacgtttgataaatcatgcttcaacccactgatctacttcaaccagcggcgcttcctgccataacttttcaaggttgtagaattggcgttcttctggcatgaagacgtgcacgacaacatcgttcatgtcaatcagcatccatttcgatcctttttggccttcaatacgacgaatcgtaacgccggcttcttcttctttatcctcaatttcatcgacaatcgcttgcacttgtcgatctgaagtaccgctcataatgacaaagtagtcagctaataaactgacaccgcgcatatctagcgccacaatgtcttcagcacgcttagaatcacctgctttgacagcaacttccaacatcgtttttgaatcaatcataaattactcctttgttaagaatgcgttataagttaatagtgtctttggaaaaacgagtttgcgcgcaccaatgagataagtcaaggtattctccaattcaattcgactagcttcttccaagttcgtttccgctgccttacgcgcctttgcttcaaccggcaaagatcgcgccggttcgataaaatcaccaacaaaaatgatttcatcaagcttggtcatttccggatcacctgtcgtgtgccgcgcaatggcagtcaatacttgcttatcagtaatgccgacctctgtttgaatgaaatgaacgccgacaacaccatgccaaacgccgcggccatattgcaacaaatccggatcgaaaccatcttcaataatcacgcgtttataggtttcaactggaatctctttaccataatcgtgcagtaaacctgctaagcctgcgcgatcaacgtcttgatcaaaacgcttggccaattcaatggcagtcgcttcgacccgcaaacaatgctcataacgcggttcatcgagccgattgtgcagccgatttaaaatttcctcacgacttaagccatgtgtcagacttgccggatattgatgttcactcacgatataatccctctttttgaatataatcaattactgaatcaggtaccagatacttcaaacttcggccattttcgacccgatcacgcacatcagttgagctgatatcaatcaaaggcgcatccacccacagaattggataacgactagctggcgtatacccacgccgtttaacaccgacaaatgtcaccaatttgacaagttcgtcaatgtgcgaccactttggcagataatccaccatatcggctccaataatgaaataataatcggtgtctggatgtaaccggtgcagctccaacatcgtctcataagtgtagctgacaccgcctcgtcggatttcaatcccttccaatccaaaaagcggattgtccgcgatagctagttgcaccatattcacacgatgccgcgctgaaatggcagttttagtgtcgacatgcggtggttgattatcgggcataaaataaactttttctaatcccaactccgtgccagctgcttcggccatgattaaatgaccgttgtgaatcggattaaaagtcccaccaaataggccaatctgttttcgccgatgctggccaagaatctgctcgcgcatttcaacggagatcacgggctgggtcaatgtgacactctgcgtcttctccatagtgatcctcttagcgtgcgttaacttccaggctaatttttcgatgatctttcttttcagcctgcttatagacaacaaccgtgtgaccaatgatttgggcgatctccacaccttgaatggccgcctgtaaggtatcggccacctcttgcggtgtatcatcggcagccggcagtaaactgattttaactagttcccgcgcttcgagggcatctttcaccccagccacaaacgtgtcacctaaaccgttcttaccaacattgattaacggcttcgtggtcatcgccaaactgcgtaaataccgtttctgtttccctgttaacatcaataacgctcctctaaccgtgtcggcaggcatagctctttaaacacaactggctgagtgcctcgttgtggtcatggatacttaccgccgtacacgttttacttcgacatgattaattttgataccaaagatagtttttctaaatgaacgcacgccgtaacaaaacatccacaccttttggcgcatagccggcaaccgtaacaccagcaggcacagtgatccagcctaacccggcgaaaactaagtcggctttttcctttggggtgaattcaaaccgaaccaatggcggaaagtctggcacttcatccggctgtggtggtgacagtaaaccgcccacatgcttctgatagaaatcatccgcattttctaacttggtgcgatgcaacgtcaactgattatcagtgtaaataacgaaactgttgcgacctccgcgaaggtaatcaaatcgcgctaaaccgccaagaaaaatagtttggccttcattcaattgataggttgctggcttgatgacggaagtcggtgagactaattttaagtctttagggccgacaaagtgtgccatctgatgccgatgaatgatccctggtgtatcaatcaatgattggccatcatccagcgggatcataatgcgatccaacgtcgttcccggaaaacgcgacgtggtaatcaaatcctcaacgccagtcaattcttttataattcgattgatcaaagtagatttaccagtgttcgtcacgccgaccacataaacgtctcgatgatcacgatatttttcaatggcatccaacagctcatcaacgccaaaaccttttttagcgctggccagcatcgtggctaccggacgcaacccttgtgcctttgcctgctgctgtaaccaattcttcaatcgattcgggttaagcgacttcggcaacacatcggctttgttcccgacaagaatgactgggttgtcacccacaaaacgatgcaatccagggatgacactgccattgaaatcaaaaatatcgatgacgttgacaatcaacgcattactttcaccgatggcattcaataagcgtaaaaaatcatcgtccgtcaacgtcaccggcgcaatttcgttgtagtgccgcaaccgaaaacagcgctggcaataaatctcgtcatcaggatcggccttgcttaaagtggcttttggcaagtatcccggctttttgggatcagtcgtttgcaaaatagcgccgcagcctatgcaacggcgctctgtttcagtgttcgtggtatccatgaatatcctcctgataatccaaatgccgtttcttggcgagtgctttaaaaacgtaaccttcaaagtaacgattaattctggtgttccacgcatcactttgaacaagtggctgggttaaaacggttcgcacaccagcaagattgcctgcccaaatatcggtcagcaattggtcgccaaccatcaccacttcagatcgcttaagccctaattgtttgcgggctttcgtgatacccacaggaagcggcttcaaagcacgagcaacatatgccacacccagcttggccattgccttgtggattcgatttgcattgttattcgagacgaccaccactttaatcccgctattgcgcaagtccgtcagccagcgagtcagtgtttcagtgccttcgggatgatcccacgccatcaacgtattatctagatccgtcaagaccgccttaatcccttgttgtttcaagctggcaggtgtcaaactgaaaatattcgttaccagccaagtcggctcaaaaactgccacaaatcttgtcccctctccggttttcatatccttatattatagccgaaaagcgtgccgagcgcgagtcagcttcattgacaggcgtggcgagctccaatcctattgatccaaaggtgtacgcctttgtccgggatggttccacgagctctctgcttgccattaaaattaaagaagctagttaagctattctgttttcttccaacagcaaaatacttcagcaattataaaaattgctatttttccaaacaagcgtcaagcttgaatgaaaccgttatctttttaaagacgaaatcatcgccttatatgtcaaaacaaggtacgattaggttgatagcagcgactcgcattcagcgaataagactgttatacttatttttagtaagtgtatcaaggaggaggcaatgtcatgacccgtttgcatcatgtgtcgctgttgaccggtgatgcaccagcgacaattcagttttatacaaaggttttaggtttacgtctggtcaaaaataccgtcaatcaggagaacgttcatgttcgacatctgtttttcggtgattaccaaggaactcctggcagtgtggttaccttttttgcgattgatcgattggggcatcgctacgatgggcaaaatcaattgggtgggattgatcttgccattccaactgggtcattggcattttgggaacagcgtctgcggatggcaggttgtgtggtgacagccacgctgaccagtttaactttggttgatccggccgatacgccggttcgactgttggtgaccgatcaaacgttaccaacgcaacttgtcgtgccaaacgatgttccgggcgaaaaccagattaccggattaattaatgtcgatctcccagtggccgatcatgaagctgaaaagaccttctttcaaaccatgctgggtgtgacccccgaaaataatcaattcaagcttgaggccggtaacaccttgacccttaagcctagcctcactgatagcatcaaacgatttggccgcggaagcatggatcattttgcgttaaccgttgaccatgaagaaacactgccgcgactggggacaattgccgcacaacatggctatgaagttgaggagtttgctgatcgcggctggtttaagagcctatatgttcgcgatcctgccgataaccggattgaatttgccactaaggaacccggctttgcgttagatgagccgcttgcccacctcggcgaaggtctcggactgccgccgaagttcgaggcacaacgtcaagccattgaaacgtattttaaaaccaaaggagtggatttccatgattgaacacacattattaggtatgaaccacgtcacagccatggccagcgatcctcaagcgatttttgacttcatgagcaaaacgttgggattgcatctcattaagaagacagttaaccaagatgcgttggatacgtaccatttttatttcactgatgatcaaggtactgccggaactgacatgacattcttcaccttccctaaccagcctaaaggtaaaaaaggcacgaacatgatctcccgcgcaagttttcgtgtgcctagtgatgcagcgttagattattggctcaagcggtttgctgaaaaaggagttgctaatgaaggtattagcaatcaattcggtaccaagattattaacttccatgatcaagatgatcaacagtatcagcttatatccgatgaaaacgatcatggggttgccggtgggacgccatggaaacacaatgacgtacctgaggaattcgcgattactggccttggaccagtgaccgttaccattttcaacttaggtcatatgcaatatgtactgaccgagattatgggttataagcaaattgctgaagatggcaactggtcactttacgaggttggcgaaggcggtcatggcgcccaagtgattcttgagcatcgagaagatctgccgattgccgaggagggctttggcaacattcaccacgcggccttctcgactgagaatcgagaaaccttaggtacgtggattgatcgcatcaagcagtatcgtttgccgcaatcaggttacgttgaccgcttctacttcaaatccgagtatttccgcgcagcaccgcaaattttgtttgaacttgcaaccaccggtccaggcttcttacaggatgaaacttatgatgaagccggcattcacttagagttgccaccattcttggaaagcaaacgcgaagaaattgaaaagcaattaaccccagtcaaaaccgactggcgtggacgttaatgattggaggttgcgatggcagaagataaagtaaactacgcatttgttaaaggtgatccaactgtctcaccattactattactgcatggccaaggcggcgatgaaaatgacttactgccaattggcaagtacctctcgccaaatagtcccatgttgtcgattcgcggtcgcgtgcaagaacaaggcatgaaccgctacttcaagcacacggaaaatggcggctttgatttaaacgatcttgaacaggagaccacttggctattttcagtgttaaatgacctttgccggaaatttgacatcgactatgagcgatttatcgtgatcggctattctaacggcgctaacgttgctgcacgggcgttattgacgcgaagtgatacattccacacaggcattttctttcacccgatggcactttcgacagtcaattcaaaacaagatcttagcgatgtcaaagtctggatgtcacatggcgaccaagatccgattgtgccagcacaaaacttcaaagtgctcgatacgtaccttgaagagcaaggtgccgatgtcacgattttccgtcatgggcaaagtcacaatttgaatgaagaagaattgacaaacgccaaaagctggctggcaaaaagtggtcggttagctgattggcgacggaggtgaaagactatgcaacgttttggttttgaacagtatggtgatccgagcgtttttgaaaccattgaggcgccgattcccgaaccaaaaactgggcaagtacaattgcaggttcttggctttggcttgaatccctacgatgcttcactgcgtcgtggtgaacaagcggcttttcgaaaagttaagttcccagttgtccccggcacagatgttcttgggcgaattaccaaactcggcgaaggggtgactgactttgctattggtgatcttgtcttgaattatcgaccaattggcggttacagcgagtatgtcaccgcctcaacttcaaaaatttacaaaaaaccgactgccttaagctttttggacgctgctgcactaccgcaagttggcttagctgcttttaacattttgcactatatgctgtcacttaagtctggccaaactttggcagtcattggcgcaagcggcggtgttggtgctatcttggtgcagctcgccaagtttgaaaaattaaatgtcattgccgttgcaggtgcccaacaccacgactatttgcagcaactcggggccgatcagatttacagctatacagatgatttacctgacagccgtgctgatgctgtggtcaacgccgtttttggcgttgcagaccacggtgcctcgctaaagctggtcaaagctggcggtcaatatgtgacgaccgcttatgctgacgttgatgttagcagcaagcccggcacaacccacctgcaattgaacccatcgaaggactattctgttcatgatggctttgcctatttagttgatgtcgcccaaaaatggggtctgcaagttcgtgtagcgcaatcatttgcttttaacgtggatggcgtcattgctgcgcatgaaatgttggaaacacaccacgccccgggcaagttgattgtgatgcaagatcgtcatgtcacccatccggttcgtaaagacatcaatcaactttaaacaaaaattgggttaacgccttgtcccgcttgttttcacgccgtatgataaacgggtgaacgaaaggcgggacaacatgaaaattgcagtttattgtggcgccaatagtggcgcggatccagcatttctacaggcagcaagcaaagttggcgcatggattgcggcacgtggcgatacgctgatttatggcggcggtaaactcgggctgatgggcgcagttgcgcaaagtgcccttgaccatggcggtgacgtcatcggcatcatgccgcaagtactcgccgatcgcggcttagccatgccagccttgacgcatttagaagtcgttgctgacatgggaacgcgaaaagccaaaatgatcgagatggcagatgccgaccttgcccttcccggcggtcctggcactttggaagaaatcaccgaagcaatttccttctcccgaattggccttaacgcaagcccaacgatcctgtttgatcaaaatgggtattaccaacctttgaaacagatgtatcaaaccgcagttgaccaaggtttctttgatcaggatgcattcgataacgtgttattctcggatgatctaaccgccatcagtacgttcattgccaactatcagccgttgggggttcggcaatatcattaaaaaaccagctcacgtgagctggttttcttaatgtgaacccatgtttttcacttatatacgcaaaaagagcatgtccactcgccaaagcgagttgtgacatgctcttttaaattggcattaagccaaagcttttttagctgtatcagccacagccttgaagccatctggatcgctaacagcaaggtcagcaagcattttacggttcatgtcgacatttgcaaccttcaagccatgcattagcttgctgtaggaaatatcgttcatgcgtgccgcggcgttgatccgtgcaatccaaagacgacggaaatcacgcttcttagcgcgacgatcgcggaaagcataacggtatgacaccatgacttgggcattagctgccttaaacagcaaatgcttggcaccacgatagcccttagcgagcttcagtaccttcttacgacgcttacgagtaactgttccacctttaacacgtggcattagaattcctcctcaaatcaaatccgatagattattatttcatctggctgagcatctggcggatccgcttcatatctgagtgggataccaatgctgacttacgcaattgacggcgttgtttcttggtcttgccgtggaaacggtgagacgtataagcatgaccgcgcttcagtgcacctgatgcggttttcttaaaacgctttgcggaagcacggtgggtcttgaattttggcatgactttttcctcctgtaaacatcagcgtgttgctggtgaagttcaccagtttgcgctttttatacgatcttgccgaaaactacttctcggcacgcggtgcaagcatcaagaacatgctgcggccgtccatcttaggatgcgtttcaacagcagcaatttccttaacggcatccgccatctgctcaaggactttgcgaccaaggtccttatgcgtgattgcccgaccacggaaccgaacgctgactttaaccttgtcacctttttcaaggaacttggtggcgttcttgagtcgagtattgaaatctgcttcaccgatggttgggcttaggcggatctccttgatggtgacagtcttttgtttcttccgagcatcgcgctctttcttttgaagctcaaaccggaatttcccgtaatccataatacgggcaaccggtggcttggcattaggcgatactaggacaacatctaaatttgcatcctcggcaatggccaaggcgtcacgcgtactcttaacgccgagctgttcaccggtctgggagatcaatcgaacttcacgtgcgcgaatactgtcattgactatcagatctcttgctatggttgttcacctccgtgtgaatttcagagaaaaaacaaaaacagcgtggccacaaagaccccgctgttcattaaataccgaactaatgagcctagcggtccaaggacttaggcgagaagcgggaacttctgctttttctcaacggatataactatacaggaacattcaggcgacgtcaagtttcagcttttagcgattttaccgctgataaaatggcgcaaactcaccactcacatagcgtcctaattcattgtcgttaggactcacgtggaattgggtcgtttctggtaaataagcttctgcaaaggcaacaacggcgtgtaggtctgttcccttatctgcatctacgaccagcaacaggctttgggtatcatcagcgcggatcatggtggtcaaataggctgcatgaacagttctcagcttcgccaagtagtcgcgcaagtgcttaactaatgtggcggtttcccgcggcggttcaccgatccgcacagcctcaccatttttagcactatcaggtttagccacgtaaaacaagttggcgcgtgatagcagcatattttcgccgtatggattgatggcaacaccttgtatatcgtgatcttcgtataaaaagttggcacagtcattgatggtggcaacagcgtattgatcatgatctgggcttttaccgaaattagcctggtcggtaaaaattggtaagaagtcctgtccttgatcatccgtaatcatgacgattgtcggatcaccatctctcgttgtcccaacaggcaacatgaattttgcagtctttaaagcagcgtaaaaagcggcttgggtctcatcattctgatcagcccgtaataactgaatcaaatgaataagttgtggattttgaacaattggttcatcagtcatcatcgttttcccctttatctcgtttctgatcggcactcactttgccacgaaacctgcgtaatttttttggtaggccaaccagccatgagagtaacacaatgccaacactgccgaaaacagccacaccttgaggttgaaattcaattttagcaaaccaccaagttgcgatgccataagcaccaacaacagttagcaacatcacaatgcccatgatcactaacaggccacggccacgatgggcaattaaccagtaaccgcgctgattcggggtccgccatggctgcttcatgtaagcgaacaaaaccaccaaatacaaaacggcagcgaggatctttgtgaccacgaataagacgagccatgaagcccataatgcgataaacaccgagtcaccctttctttttacgtgtgtcgtaaatgtgtccagtttatcatacatgctgaaaacaaatggcggatgtgctaaatttggcgagaacaaacctgttcctaaagatactaacaacaaaattatgaatgaatggagaaatcaccatggcaacaattgacttagtgaggcatgctgaaccagacatcacgattcatgatgattttttgcggccactgaccagcgctggtcggcggcaaactcagcagttggttgccagtttgcatcaatatccgtacacaggctttttttcaagcccactcaaacgtgctgttgatacgatcacaccgattgcagatgatcacggcttacccgttcaaaaaaacgaactattggtggagcgaaaaatgcctgcatggctgccaaatttttctgaatatgttaatcagcagtggcaagatttaacattctttgaaaaacctggtgaatctattcatcaagttcaagaacgttacctttcatttttatatggactgccaagttcggcattcgtcgctgtcggtagtcatggcacggcgataagcagtcttgtcgaagcggccatccccggtatcggctatcattttttctcgaaacttggttacgccgctgtcacccgtatcgaaatgcatgcaggcaatgtggttcacctagctgtctgggaaccaaaatcaaagacatttaaagttctaaaatagtgtttccaaacctcaaaataatccaaaactgatggcgcgtttcgggattttgatcaaaagaaaaaggagctttgagaacaatgtctcaaaagttccttccccatttgattgaaaatgacactaatcacctaaaaccttggtcgcttcgcctggcttggttttgccgtcacggctgtaattcttcacttcagcaactaaagcatcaatgaacatgttgcctgcttcttcttcggtgtgttcatccccatagcggcgaactgaaaccgcagcatcattcaattccttatcgccgacaacaacggtgtatggaatcttcttggtttgcgcttcacgaatcttgtagcccatcttttcgttccgatcgtcaactttaacgcggagaccggcggctaacatttgtttcttaatgcgattgacgtaatccagatgcagatcattgttgactggaatcaaaacagcttgtgtcggtgctagccaagttgggaaggcacccttgtagatttcggtcagataggcaatgaaccgttccatcgtgccgacaatcccgcggtgaatcatgactggccgatgctcttcaccgtctttaccgacgtaggttagattaaaccgttccggaagcataaagtccagttgaatggttgacatggtttcgtcattgccaagtgcggtcttcgtttggatatccaactttggaccatagaaggcagcttcaccttcggcttcgtaataatccagtttcaagtcgtccatggcaccttttaacatgctttggctacgtgtccacatttcgtcatcatcgaagtatttttcggtgttcttagggtcacgatatgaaagccggaaactgtaatcggtgatattgaagtcttcgtaaacatccatgatcaagcgcagaatctttttgaattcttcttgaacttggtctaaagcaacaaaagtatgaccatcgttcagcgtcatttcacggacacgttgcaggccggacagggcacctgacttttcataacggtgcatcatgccgagttctgcgatccgcaacggtaattcacgataagagcgaatgtgatggttataaatctgaatatggcttgggcagttcattggccgcaattccaacatttcgccgtcacccatgtccattggcggaaacatgtcttcgcgatagtgatcccaatgaccagatgtcttatagagatccaagttagctaaaacaggtgtgtagacgtgttcatacccatcggcaatttccttgtcaatgatatagcgttcgataacacgacgaatcgtggcaccatttggcatccagtacggcaagcctgcaccaaccttaggatcaacgaagaatagatccaaatcacggccgatcacccgatggtcatgttcagcagcttcttggcgtcgtttggcatcatcttccagacccttttcgctccaatatgccgtgccgtagatccgttgcaacatcgggttgctgctcttgccttgccagtatgcaccagccactgacagcagcttcagatgcttcaagtccttgagacttggtagcaacactttttcttcaaaatcaacgaagtcgcctaacttatagcctttgatcggatcgccagcagcttcaaccaactgcttcttgaatggatcatttttgaaggcttgaaaagcttcggcgcgactcaacacaactggttcaagtgccgcgttttccttgataatcgcttccattttcttttgaacggttggcaaatcatcaacactcacctgaccgtcagcacgatcggtatcgtagtaaaaaccgtcttccgttgcttgaccctgaccaaaatgaatatccgggtataagtctttcaaagcagcggccagtacgaacgctgctgtctgccgcaaaacggtcaaaccttctgcatcatccttggtcataatttgcaatttaccagaatgcgcaatcggttcgtcataagcgatcaaatcgccatctaacttgccggcgacagccttctttgccaagctattactaataccctcggtgattgccttaactgtggtgccatcaggaaactgtttgacgttaccatcaggaaatgtaatatctaatgccatgagtaagactcctttattgttttttcgaagaaaccaaaaaatccctgacatctcctaagagacatcagggacgatcagtgatcgcggttccacccagtttgccaacagcaccggctgttggccacttaattgacgcgtaacctgcgtaacagggccttgcggcaatctcgagaagtggttcggatcagatcttgcaagactttcagccatggtctcgctctctattgaatgatcctttgttgcttccgtcttcgatagcttcattgaaacacattgcgcagtcaggtgcaagaggttttctgaaaaagagcgctctctggcgcgtttagaaaccggaacataagtggcctcaagcctaaatggccgggctttggtcattttaggcttgaggtccttatgtgcaggtttctgcaccagagagcgcgtttcagccacagcgtgaactagctccgtccgcacggctacaagtaattctggaaataacatcatccgccaacggtttacaactgaatagcgctactttgagcgtcaatctgccaatggattgcgccgattttcaccgccgacctgcacttctttagctaaaaaacgaatacgttccataatacgttcagccttaagcatctccgaattgcctcgatcagtacctgctaacgactcagtcaaatcagccatacttttatttgaactgaatagtgtcggcaacttttcttgcattcgatattgcaaaataatacctagcacatcatcgcgcacccaagggctaatactctcagcaccaatatcgtccatcatcaggatttgggcccgcttgacactatcaattttcttcaaaacactgttattgccgatagcacttttcatctcgactacaaaagttggaacatgaatcaaggtacttgcaattccaccttctcgagctaaatcatttgcaatagcacccagaaggtaagtttttcctaccccaaaaggcccactgagataaagaccttggtgaaaatctttaggtttcgccacaacttcaaacgaaaatctatttgctgcgataagagccttcgttcgctcgggcgtttgatcgtattcttgtaaacttgcgtggcgaatatctttcggcatattgataggagtaactaaagattcttgttttgctctcttatcagataccattttttcattagtcggttggtaaactacatcaattaaacgattagcgacaactaacatgggcctatagcctggtgcgagtggtaattctccgcgatttatcttgttacgctcactaacaaattcataaatcttggcagtaccacgatcaatagcatcatcagccaaatcagactgatgtgccttcaagaaggcctgaacctcagagtcttgcaaagccttcttgaccattttgaaatagcgatcacgccattgtcgtgaatccatcagcaatgcaatctgcttacgcatgtcctccatcagttttccctccttgttcgttaagctctttccatttcttcatttgttcggcgagtatcttcttatcagtttcactgatcgtttccttttttggcttataccccgcttgtgcccaatctggcaacttctcctgccgcggacctttggcgctgccttgacgccgtttttgaccactggccttctgtttttcaaagtcacttatctgtttcaaagcagcctcgggactgttcacattagctttcagccaactgttagcaattgcatcaagcaatgcctgattgatactgtcattggttcgtaaaatataatcaatcaaaatattgatcgtcggcgcatcgaacacatttcgctcactaagctgctgaacggcacgtaactcgttgttagccgggtacattcggacattttttgcctgcttggcggcggttaagaattggcgcggtggcatacttttggctttttgcaacaaagcttcgtcggctgatgccacttttggcggtgccgtcgtggtcgtcggctgcgcatgtggttgtgctcgggtgtagccttgttcagctaagcgccgcaattgactcaaattaattttgccagtcatgacatctgtggcgcgactaatcaagcgagcaaaatccggcggttgaatcccgtaaaaaccggcgatttgatacaacgcttcctgatgcgtggcgagttgccccgcttgaatattactattcgccagcatcgctttgactaatgcccaatcatagccgccgcctgtgccaagccgtggccgcgtggcttctttttgcgtcatatctgatttagctgccaccactgctggtggctccttgctcaaatcatgatcaaaccgaaacacatcgagaaaactggctgtaatctcctgccattcaggtctgcgcactggtttgaggctaaattggccaaccagctcatcgtatcttttttccccgactttgtcgtataggagcaacccgagaagatcgtccttgaaaaaggcatcaggtgccaccggtgcatacaactcataagcgtagtaacgccctaatgagtcgacttgcgtataagtgcgcaataacccgaccgcctccagtttgacacgcgcattgaataattgatcaatatcaatatctaacaaatccagcagccataattgcagacgtcgatcagtcactagtgcgcgatctttaacttcctgccacaggctcagatacaatgccatcgcaatcggcccgatgagcggctgatagagtgaaattgccactttttcgtcaaaatcactcaaatgaccggcttttgttaacacaaaccctgcctgtggactaaatgtatcaggacgttgcatgcactttcacctcttttcagacaacggacctgagacatttgcctcaggtccggtttaccattttcagctgcgatgatctttacttcttggtcttttctttcttcatcatgtcctgcaattcctgcatgaagacggacatatctttaaactgtcgataaacgctggcaaaacggatataggcaacatcatcgacatcggctagtttagacatgacaaactcaccgatcgcctgactggagacttcgttttcaccaatcgcacgcaactgattttcgaccgaatcgacaatactttgcatttgttccatggtaaccggccgtttttcagcggcccgaataagtccttttaggatcttctcacgattaaattcttcacgtgtaccattctttttgatcactaacagcggggtttgttcaacccgttcaaaggttgtaaaccgaaacccgcaattttcgcattcgcgacggcggcgaatcgcacggccaccgtctgttggtcgggaatcgacaactcgcgaactattatgatggcaatggggacattgcacgactccaccctcttaatcaaagtttgatagcttattatagcacgcgtaagccgcttatgatagccgttgcagccggtggatcaaggcattggcttgggcaatggttgcctcttgagtcccattattatcaatcacaaaatctgccaatgctgccttttgcgctaacggcatttgcgattgaattcgggcctccgcgtcagcctgtgagagcccgtctcgtgccattaaacgcgatagttggatattgggatcaacgctcacaaccgcaacaccgtcaaagtcatcggcataatcggcctcatacaacaaaggaatgtcgccgacaacgatggcggccccaccggcttttgcctgtgcaagtgcctgactgatggcctcgcgcaaataaggccgattgatctgattcaaggctgccattctgcctggctgggaaaaaacaatcttggccagcttggcgcgatctaggctgccatccgcgcgcagcacttcaggaccgaaagcttgagcaatgcgcgcaagaacaggctgcccaggctcgacgatctggcgggcaatgacatcagcatccaccaccggaaacccagcggctttgaaagtgcggcttaccgtcgatttccccgatgcaatgccaccggttaaccccaagagataagtcacgctggccgcctcctttgatgtaatggctgacagtgtgggcagtaatgggttccgcgctgaccaaccttaattttgacaatcgtcgtgccgcagcgatcgcacggggtaccttcccgatcatagacgtgcaaggcattttgaaaagaaccgcgattgccttctgcatcaacatacgtatgcgcgctggtgccgcctgccgcaatggctgcgtttaattcttggataatcgcgtcatgcagtgttttgatttctttagatttcaaggtatcagctggctgcagcggattgagccgacttaaccaaagtacctcatcagcgtaaatattgcccacaccagcgaccacggtttgatcgagtaaaaccgacttaatcggtttatgatgacgtttcaagcgctgggcaaagtccgcttcgtcaaaggtgcttggggttggttccggcccaagtttagcaagtgctgtgacctgatcctcctgcccggttttgatcagccgcatccgcccaaactttcgcagatcccgatagcgcaactgactgccatcctgaaaagtgaacgtaacgtgatcgtgcttatcaaaaggtgtgtttgcatctttgacaacatagtaacgcccttccatacgcagatggctgatgatcgtttcaccattgctgaggcgcatcaaaagatacttgccgcgccgatcaatggtcgtgatctcactgccgacaatttccttttgaaaagtcgccaacccattgatcaggattttctcccagttagtgttgatggcggtaatgactttatttttgactaacggcagaagcgagcggcgaactgtttccacttcaggtaattcaggcattgaaatctccttatttagcgtcgaaccaagttggtccataatgactttcaacctttaatggcacatcaaggtgaactgctgagtccatgactttgggcacgagctcgctaagctgggcaatttcttcttcaggtgcctcgaagatgagttcatcgtgaacctgtagaagcattttagcttgcaaaccagcctcatccaaggccttttgcatgcgaatcatggctaccttgataatatccgcagcgctaccctgaatcggcgtattcatagcggtccgctcggcaaacttacgcagattgaagttgcgtgagtgaatttgtggcagatagcgccgccgatggaacagggtttcgacatagccttcttcacgcgccttcttgaccatcgcatccatataatcatgaaccttaggatattgatcaaaataaccatcaataaacgcttttgcctgtttacgggaaatgccaatgttttgggatagaccatagtcactaatgccatacacaataccgaagttagttgccttggcttgccgccgcatatctggtgtgacttgatctggcgaactcaggccaaaaatcttcatcgcagtgttggcgtgaatgtcgacgccatgtttaaacgcctcctgcatattctcatccccggaaatatgtgacaatacccgcaactcgatttgggaatagtcagaactaaaaatttgccaaccttcatgtgacggtacaaaggccttgcgaataattttaccttcatcacgagcaggaatattctgcatgttaggatcaactgagctcaatcggccagtttgcgtcaaagtctgcaaatagcgggtatgaatcttatgatcaggcaattgcgccttcaacaagccgacaacataagtcgaattcaattttgcccagccgcgataatccaaaatgtcctgcacaatcggacttgccgatttcaattcgttcaacacgtcaacgcttgtcgagtaaccggtcttcgttttcttgatcacaggcagattcaatttttcaaaaagaatttcgccgagctgcttcggtgagttcaaattgaacttcaaaccagcttctgcatagattttttcttccaaaatcttgatgctttgtgagaattcagtgcccatagccttcagtgttttagcatttaaggtaatcccttgaatttccatttctgccaaaacccgagaaagcggcatttccatatcagtgaataagtccgtttgttcctgtttttccaaatcaccggtcaaatcaggccgcaatgcgaacaaagcatcagacttgcgagcaaactggccaaacagcttatcgtcttctggcacttgccgtttggcgcctttgccataaatatcctcatcacgcggcaagtcatgataatcgtgatcttcagcgattttacccaaatcattgctgttttcgtcaggattaatcaaataggacgccaataacacgtcaaaagcgatatccggtaatttaacgccgagtcgattagcggcaacgatgtttcgtttgccatcaaaaactgtcagatcgcgtttggcatcttccagccaccgtttaaccgctggcagcgtcagcaaggtgacatcggtactcacgtaagtttcttccttagtgccaataaagaaaccgatttgttcggccacgtgataattatcctcgagcatttcaatctcaaaagtcagaggttcggtcagcttggtgagtgcaagaatcgattgctcatccagtacggaaaaatgaaccgcctgaacaggtttagcgacactgccaccgatttttttgagcaacgaattcatattcatttttgtatagaagtcccagagtttgtctaaatccggtccagcatatgtcacatccgctaagtccacagtaagcggtgcatcgcgatcgatcgttgccaactgtttgcttaagaaagcgttatctttatcgttgatcaaattctctttaagcttgctctttttcatgtcatccacattagcatagaggttttccatgcttccgtattgattgagcaatttcagagctgttttttcaccgaccttggtcaccccaggatagttgtccgaggtatcacccatcaaacctttgagatcaataatttgagccggtgtgatgccaagcttttctttgacatgtgctggggtgtaggcttcaagctcattgacacccttcactgtcacttgaactgtggtccgatcggtcgtcagctgcgtcaaatcgcgatcaccagtgacaatcgtcgtttcccagccggcctcatccgcacgcttagccattgtgccgataatgtcatcggcttcgtaatcctttaattcataatgcgcgatgcccatgtcatccaacaattccttgatataaggcaattgttccagcaattcgctcggtgtcttggcgcgaccacttttgtaatcagcatatttggctgtgcgaaaagtcgtcttgcctgcatcaaatgctactaaagcggcatctggttggactgcctttaaaacaatctcgagcatgttgttaaacgcataaatggcgttggtgtgcaagccatcttggttcgtaaaacggtctaattgattatataaagcaaaaaatgcacgaaatgcgactgagttaccatcgactaataataattttgttttgctcgccataagtgggcttccttttctacggccgctactgtcaccgcgacctgagttagttgtcatagtcattgtaccaaattctgctaaccggtgacttgctggtcaggggaaaactggcagaaaacaaaaagagaactggcaaataccagttctcttgaacatttttagttaattattgttattcccaacacccagaatctgtaggattgcggtgaacaggttcaagaagtcgagatagagcattaacgcaccaagaaccgctagcgagccttccgaaacggcagcttgtccatcattgccagtggtgagatacaggttcttcagccgctgcgtatcccacgccgttaatacaatgaagataatcaggacgccgtatgaaatcagcagttgcatgcctgaagaaccgatgaatgcattcacaatcgacatgatgataatcccaaacaaggcaaccatcgcgatattaccggctttgctcaagtcacgcttgccaaaatggccaaccatcgacatgaccagaaagacaaccgctgtcgtagctaaagcaacggcaaggttagtaccgttcgcaaccatggcaactgaagcgaacgtgaagccaaaactagcggacatgaggtaaaacatcactgttgcataccccggacttgcctgtgcgcgacgccctgtcacaaaaaatgacaaaatgatcggcataaaagccatgatccaaaaaacaatcggatgcccactcacaaaactggtgtactcagctctgaatggaaatcctaacaaataactgacgagcgccgtcacgaccagcccgctccccatcaaggtatagatgcgggagaagaactgtgtcaagccggcctcgtttacaacacggcgttcttgcatagcgttcattcctttcaagtaactctttcgagtatctgaagaccattataaccggaatgatgatatttgtcagtcaggcgaaagaccgatctttattatgagcagttttcgatcattttagacacagttttcgatgtccaacaaatcatgatcacacggtctattcttcagccaataaggtttcgtaagctttttcatacttttgaatatcaccggcccccataaagacaaccactgcattatgatactgcagcaaaggcttcatgtcttcctgatgaatcactgcagcgcctttgatctgcgcggtgatatcttcggatcggattttaccagttttctcacgagcagaactgaaaatcggggttaagaatgtttgatcagcttggcttaggacctgaacatattgtggttcgtaggcctgcgtgcggctgaaggtatgcggctgaaagacagcaataatcgccttgtcaggatacttttgacgagcagcatctaaggttgctttgatttcattcggatgatgagcatagtcgtcgacgatgatcatgtccttgagatccttttcggcaaaccgacgcttaacgccactgaagttgccgagctcgcgggcaatcaactttgcatccagcttttccatgtgagcgaccgcgaccacagccagtgcatttaggacgctgtgttcaccaaacagcggcacaaagaaatgaccgatcagttgatcgtggaagtaagcatcaaagctgctgcctttcgtatcgcgatcaacgttgcgagcctgaaaatcatcacggtcactaatcccataataataaaccggcacctttgcctttagcttccgcagccaaggatcatccccccaagctacaattgcttttttaacttgattggcctcagtttcgaaagcatcgtatacatcttcaaaaccagtgtagtaatcagggtgatcaaaatcgatattggtcataatcatgtagtcaggatgataggccagaaaatgccggcgatattcatcagcttcaaatacaaagaatttggaatcgggaatgcccttgcctgtgccatcaccgatcaaatagctggttttagcaacgccgcttaaggtatgggccaacaaaccggttgtactggtctttccgtgcgcaccagcaaccccaatactggtataaccttcaatcagcttgcccaagaattcgtgataacgataaatcgtgagtcccaattccttggcccgtttgatttcaggatgatcgtccgtaaaactattgccagcaatgacagtgtaacccggtttcaggttagccggatcaaacggcagcatcttaatgccggcagcagcaagtcctttttgggtaaacgtatattgggtaatatcactgcccaaaacctgatgccctaaatcatggagcaccaatgccaatgcgctcatacctgatcctttgataccaataaaataataggttgcctctgtcatgacgtttgttcctctttctttgcttgactgtaataaacttcccgcggctttgcgcctttagctggcgaaacgagatgcttcgcttcaagcgcatcaatcaaattagccgcgcggttgtaaccgatagaaaaaacccgttgaagctttgaagtcgagatatgccgttcaccagacagatagtctagaacttcaggcatcaactcgtcttcatgtgacacgctggcttcagccgatttgaccaagccagccggatcaaaaagataacgtggtccgcgccgagctttgacataatcaacaatcgcatcaatttcgcgatccacgaaggttccttgcaggcggatcggctgactagcgccattgcccagatacagcatatcaccacgaccaagcagccgttctgcgcctgccgtgtcaataatcgttcgtgaatcaatttggctggcggtcatgaaggcgatgcgcgtcggaatattattcttgatggtaccagtaatcacatccacacttggccgttgagtggcgaccaacaaatgaatcccagccgcccgggccttcgccgtgattcgcgcaatgtcatcttgaatctcactgcccgcagctagcatcagatcggccaactcgtcaatgataatcactaagtatggcaggacttgcgcgtattcgtgaaaacgctcggcctttgcattgaactgttccaaattacggacaccagccgccgccaacttcttatagcgatcattcattgttgacacgacccacttcaaagcggcactggcagctttgggatcggaaataactggcgataccagatgtggcaagccattataaccggcaagctccactgcttttggatcaatcagtaataaccgcacttgttccggtgtagccttatagagcaaggatactaacagactgttgatgaagacagacttccccgaaccagttgctccggcgatcaagccatgtggcatcctagccaaattggtgaccacaggctggccaaaaagatccacacctaaagcaatcgtcaatggcgatttagcctgctgaaaagctggggtatctaggacttcgcgtagcatcactggtcgcggtttcagatttggtatttcaatgccaaccgtatttttgccaggaatcggtgcctcaatccgaatgtcttttgctgctaacgccaatttcaagtcatcattgaggttcgtgattttattgactttaacaccactggccaggcggacttgaaattgggtgacagtcgggccaacagtgtgagcgaccacgtgtgcatccacgttaaaggcttgcaacgttttatccaaccgatcgctttgtgccacaacccaatcttcttgggcagcctgatcaactttgaccggcgaagcaagtagcttgagcggtggcagtgtgctaacgcccggtgttggccctgtaggtgcggaacctgtgtcctcagccgcagccattgatgaaggtaaaataccagttgacggtgattgcgttagtgctgacgttgaatggtcggcatcattggctaatggtgtttcagccgtcgttgaaggtggccttgatgtttttggtgatgtttgcacctctgcctgagcttgctttgcctttgccttctgggcagctaattcacgccgtaactttttggccgcatgtttgcgccgcaacgcctcaattctcgctgccttgcgactgttaggcgcatgtggcttattgatgacagactgtgaggacgaatcaacaaacggcttgttaaccgatgctggagcctcctctgcctcatcagcggtcacagcggtcagtaatgtctttttttcggtctccgctgacttagcctgtggttcaacagcagatgttgccggtgtcgaagacgataattggtgcgtgtcggttggtgttaccggtttggcggcaactgacggtacggttgcttctggcaaagtctcatcaagcggcttttggttctgcgtcccggcttcatccgattttcctgctaataaggtatcttcctgcggtgctttagaagcgtttgctcgtctgtcagcctcattttcatcttgtttttctataaatgacgtcgtcgatttggctgtattcgtatcagacggtgtcagcgaaatatcatgattggcggccatcttattttcgatgccatggcccgcaaaaagataaaccgtttgcgaatctggtcgcaaaatctcagcaatttgtgcgtaatcggtacgatcaacgggacgccgatgagctgtactgtttggcgttgataggcgcgacaactcatcgcggccccgcggtcgttgcgggtgatcaagcgcacgcaaatcagcctgagcctccgtgaccttacgcgggtccagatcaggctttggttcatgcgccaattgcggcggcaactgatattgttcctcgtgttgcgcctgtgtccagtccgaagtattcaactcagattggggttccggcactttattttgatgtagaaatgccgggccatcataatgcgccatgattgaatccccttctattcatgtttctagcagtgcctctattttagcataagcaccgcaaccaataatccttgatccctaaaaatatcaccagcaattggaaaaagattcatgttaagaccagtgattttgcaattggaggcaaaagaaaagacgtaagcacgaggcttacgtcaaattttttcgttattcgcgatcaaaacaattacaaccggctgttcagatgggcacaaattatgatgcttgaacagcaacaacggcctcggcttttttagcatcaaatggtgtgcctgcaggtaaactatcaggcatcaccaagataccgcgacgttgtggcgcgccaggaatgcctaactcacgggcactgctgatcatgccgtaagagtcaacaccgcgcaacgagcccggccagataattttgccatctggcatcatggcacctggcaaagcaacaacaaccgtttggccgagtgctgcattcggtgcaccgcaaacgatttgaacctgttcattaccaatatcaacttgcgtcacatgaagatgatcagcatcaggatgatccttaaaatcaacaattttgccaatcacaaacttaggggtttcatcaaccgctagtttacccggcagccctgccgtctgaatagcctgattaagctcggcaatttgtgttgcggtcaacacaaggcgaccttggccagttaactgaccaagccactgtgtcacgttgaaaaagttgtagccaatcacgttgcctttatcattgagaatcgcaacaatgtcaccacgtcgctgaattgtttgtgttgccgtatcctgacctgtgatggcaagcaaggtgtcgccaaacgctggttgattataactggtaatgagcatataaacctccaaaaattaatgcaagccgttaatgaaatcttcgacttgttgtttcgtcttacgatctttattcacaaaacgaccggtttccttgccatcgttaaaggcaataaagctcggaatgccaaacacacccatatcttgagcaacttctaaattcttatcgcgatcaaccgcgatgaattcataatctgaaaagtccttctcaatttcaggcatagctggtttgataaaacggcaatccgagcaccaatctgcagaaaagaacaacatttttttacctggttgcttgacctcatttaaaattgctgcattagagcctaattctttcatagccaacatcctttcgcttactatttataagtaactataacaggaaatcgtcttaagatcaatgatgctcgtgctgtgttacattatactcaaggtgataaagcttgaacaggtcaacaaaagccaagtcacacatcgtcagatcagttagagattagcagaagacgtcagcaatgtctcgcctttatatcagttttaaaagaacgtccggaataggttggacaggtccgtcttcatcacaaaagggggtcacaaatttggcaattttcaaaaagaagtcgaattggcgtgtctggatagccgctgctgcggtgacggccggcatggcttcgattgtttatcggcgcctgtattatcgaaccattcctaatcgcattttgtccatcgtcaaggccaactttacaaatcgcggcaccatcgaaaatagctggatcaacatgcagccaaccgaacgcgggactggccgtgatcgctatcgcgtgtatactggcgggttgaccctgcgtgaaggcgaccgcctcaatcagtttgcctttgctgttgagcccgatggtaccttaagacaattaaaacaacttcacgaaccgattaatgcttaaaatgcgcgacaagttcgtagattcgaccgccatcagcgctgaacttctcttcgtattcagtgggcacgttatccgtgacgcgtttgtcgtgatgtaggttcaaggaaaccaaatcgaacgtcatcccaaaatgattcatgctgaccaaggaatattcaaacaacccttgattatccgttttaaactgcagcaaagcatctggcttcataatggcttgatactgtcgcaaaaagtcacgataagtgagccgccttttttcgtgacgggtttttggccacggatcggagaagtttaaaaacaagccatcaatctcaccttcactaaaataatcggttaagtccgcaccatcgcccagcacaagctgcaagtttggcaattttaaggcaacctgttttttcagaatcatcgctacagcggcttcctgtaactctaaagcaataaagtttcggtctggatgggtcttggccatttcgacaataaattggcccttcccagagccgacctcaagatacaatggctgtacttggtcaaatcgcgattgccaatgaccttgcatcttttctgggcgaaccagaatcatctcaggatgagccaagattagcggtttcgcccactgtttgttacgtaatcgcataaaatttctccttaacttgaacattggctaggtcaaagtacaccgtgaccgctcaaaaggcctgggacaaaatcactttttgcctcaggccttttttgatgaatgaccttgcttgtttgcagcacagcttaccgactcgcttgtaaacattcgaattgatgcaaaacttgcgcaacttcttcgaatcgttgatgcgtggctgctaccttaatatcatgaagcaaatgcagatcaccgtaccagtacagtcggcgtttcaaatcctcatcaagtcgtgcgccgtaagcatccaaaaactggtggcttgtggctggactgccatagtgggcaagtacatccgcgagatcataagccggatcgcccagcgccacctgctcccagtctactaaatacaaccgaccgcctgcctgtaaccaattcttgtggttcaaatcgccatgacaaaccgtttgcacatccgtgtgcggtaaccactgctttaaatcgtgcagagccgttttgatcttaggctgcgcagccacatcgactgggaaatcctgaagtagtgcgattcgtaattgctcaggatcaaggacttgaccacccacttgacgtaataaccgttttaacagacttgagtggtgcacctgtgccaacattttggccacgactggcaacatcatttgttgccgcgttaacgtttcaccgtccagccactcttgagcggttagcacgtctcccgtactcacccgccgcgtccacaacagccgcggggtaatgtgttcaactgatagtgccgcaagaaacggcgaggcattgcgcttaaggaaatatttttgattggcataaaccccaagaaacgcacttccggtggatccacctgcaggctgcagggaccacccggaatctaattcaaactccataggcactactccttacttctggccgcaggaatgattcacaacatcaaaaagacactcccaggcgctcgtgcgtccacgctcaatattactaacttgcgaaattcacgtcaagagcagagcgcaaactggcccgcttagaaaccggaacataagcggccacaagtgcgatggccgcactttggccattgtgcttgtggtccttatgtgaaggtttctgcgcctgtgaacacgtttaggcagagtgtgaactggcgcatctgtcattcaacgcatcgcatcatgtaccttcaaccgaacgcgtgcataccatcgcgtgaagccccagacaaatgcagtcccaccaacaaatatcgtcaacgcggcgagccactgcagtcggatcaacgcaaccagtgtgaaaacaaccacttcaagcagcaacaacgtcatcaaaagccgttcaaaggccgccagtttttgatttggtgctactggatacaagtgcgtgaagacaatttcatcatattggaagaagaatggcaacagctgaaagccaaccatatacaagaatagaatcgcaaaaccaagcaacagccaccactgagacaaaaccgccacgataatcgcgccgatcaccagtagccgcaagtacaacccaagatactcaccgccacgcaaaaagccgcgcagatacaagtatgcccacgtctctgacttgcttggcttaaccaacttcaaaagtggatcgaggtaccggcgacgatggacgctattggccaaacctggcacatccgtgaatagattataaaatcgatacagtcgacccatgcgatctgcttcgaggtcaattaaagcttcgaaattcaataacccctctgccaacaaggaacttcgcagccatctgaagaccaaattcagcgtcagcgccactaacaaggccacagccggatgcaagtaaaaacctaaaaaaagagctgcgaatgtgatgacaagcagtacaagtcgtggatgtcgccaattgatcggcagatgatagcgctgaagcaattgcagccacaagtcgagatctttgaataaccacacagctagtagcagcgtcaccgtcgcactgattggatcttgacccaattgtgcaaataatggccacatcgccaaagccgcaaaacctaataaagttgccggtaaaatcatgctgtatcgccgtgccttcaacaaatagtcactgaaggcctctgcttttggcagtaagaagacttgatcgggcgcctgcgccaacgtggctaactggccaagcgcgattaaagccgtaaaaatgacagccagacacaaagctaaccaccaagatggctgcaatgttttcactaacagactgtaggcatataaggcaccgccaaaaagtattagcaagaccagtacaaaatggtcattgaacaccaatcgcaaatatttttgctgttcttgaacatgttgtcgaagtcgagttcgccataacgcgaccattactgttcctccgtcattttcatatagatgtcatccaagctgccatcctgaagatcaaattgctgcttcaaagaaggtaaatcaccagttgctctgactttacctgctttgatcaaaacgaattcgtcagcatattgttgagcggttgccaaaatatgggttgacatcaaaatagacgctccttgctccttttttgctgtcaccaagtccaacagatcatggacggccagtggatcaagtccagtaaaaggttcgtcgatgataaaaagctgtgcatgcgtcataaacgccgccacaatcatgaccttttgctgcatcccttttgagaattttgctggaaaccagtccaacttattgtcgagtcggaacattttcagcatattatcggcatcttgccatgcaaccgtcgcatcaagatcgtaagccatgatggtcatttcaagatgttcccgcaacgtcaattccggataaagcaccggtgtctcaggcacatacgcgaggtcagctcgaaaaccagtgggatcatcgtgcaatgttttgccatcaagtgaaatcgtcccgctttgtggggtcaacaatcctataatatgtttgatggtcgttgacttgcccgcaccattcaaaccaattaacccgacaattttgcctgccggtacggtaaagttgatatctttcaagaccgttaaattgccgtaaccaccggtcaatccttcaattgttaaagtcatcttaccagtcccaatctgtataatttcagttagtgatatgatagcatgaaatcaaggtttctattaaaaaagcgcaagcagaaatgaggcagcaacatgaatgattgcattttttgcaaaattgtccgtaacgaaatccccaatgttaccgtatatgaagatgacgttgtcaaagcctttctggatatcacgcaggttacaccgggacatactttattagtccccaaagttcacattccagatattttcgcttatgacactgaacttgccgcagctgtttttgaacgtctgccaaaaattgcccgcgccatcaaggccagtgacccggcaattaaaggtatgaatattttgaataacaacggcaaggtcgcctatcaaagcgtttttcactcacatatccatttgattcctcgctatagcgatcaagatgattttggcatgcactttggcgatcacagtgcacagtatgacacagagaaacttgaagcggtcgctgacaaaattcgtacccagctggaggcccaagcatgaaatttaaacacggctttttactcggagcactgaccggaacagtttatgcgctgttgactgcaaaaaaaaccggtccacaacttcaacaagagatcgcggcctactttgaaggtttatcagacggggttggtcaggtgcgtgagagtgttgctcagttcagtcaatccctcacccatttatctgacgaactcaacaatactttgaaacctgccatgaaagatatcacagatcgggtcgagacttttgaatttgaaacggccccgcgcgttgatgcgatccaaaagcatgttgaaaatatcaatgatgctgtcagcaatcttgatgctatgccgactgccgatcagcgtgaacctttaccaaaacattgaaaattgctggcgatgcccatcaattaagtcgtgacggtttcgtgaaacttatgtgaagatccgcgtgcggcagtaagttatggtatagtagacggcagtgttaaccgaaacttttaagattaggatgtgtgattgcatgaaaaaatggattctcggcgttgttggtttgtttgtagcagtgacgttagctggttgttcaagcagcacggttgcaaacatgaaaggtgccaaggtcaccaaagacgagtactatgacgccatgaagaagaccaccactggccaagcaacattgcgtaacatgattgttttgaaggcattggaacaacaatacccgaataaggtgtctgataagaaggtcaacagtcagttcaatacactgaagaaacaatatggttcttcattcgatacaacccttgaacaaaatgggtataccgaatcaagttttaaggatcaaattcggacaaccttgtactcagaagttgccttgaaggccctcaaaaagccaacagaaaaacaaattgctgctcagtggaagaagtatcaaccgaagatcaccgtgcaacatatcttggtcaagaccgaagatgaagctaaacaaatcatttccgactaccaaaaagacccaaccgaaaagaactttgaggcccttgccaagaagaactcaatcgatactggaacaaaagataagggcggtaagttgacggcgtttgacaacaccgatactagcttggattcaaccttcaagaaagcagcctttaagttaaccaaggccggcgatatcaccacaacaccggttaagacgcagtatggctatcatgttatccgcgttatctccgttggtaaaaaaggcacgatgaaggaacacaagaaagatttggaaaaccagctctatacaacatggcagagcgaccaaacggtgatgaacggtatcatcaccaaagtgcttaagaaggaaaatgtttccattaaggataacgacttgaaggatgttctttcaagctatctgagcaccagctcaagtaccagtacttcaaactaaaaattaaatcagtgttagcacttgaaagcctcgcaattaattttgcgaggcttttatttgtgttgcaaacatgacgcaatgaatggcaagtgattgtttgtaggactcaaaaaaaggctgataaagataggcgctatcccatctttatcagccttttgacaaccacatgactacaactaaactgactgaattcgcctagtgcggatccggaaaagtttgaccatttttaggtcgatagaagcgacgattgtccataccgaaaagtcgttctgtgaaggtaccaggatcaacatgttggtaggcggttgtcatcatattgattgatgcgtccaattcgtctaaatcatgcaacacttgcgcttcaagaagctctggccgcaccggcgagccgtattcaagcaatccgtgatgtgcaagcacgacatgacgtagtaagagcatatcttcagcgttgatatcaattttaagttgttgtgctgctaagacaatctgctcgtcaatgagaacgatgtgaccaatcaagttgccttcaaccgtgtaatcagttgagattggcccgcttaactcaatggtcttaccgagatcatgtaaaattgcgcctgcatatagcaaacttttgttcaagctcgaatactgttgaacgacacttttagcaagtcgcaagatgcttagcgtatgaaaagcgagaccaccagcaaaagcatggtgatttgacttggccgccggataactgaaaaatgccttcttgtgatcattgatcagtttacggacaattcgattccagttagcattggtgatttcgaagatgtaactgttcagttcctcttccatatcactgggtgcttctggcgcccgctcaacaaaggctttaggatcattgccttcctcttgggttgccaaccgcaatgaaaaaatcttaatttgcggattgccttgatataattcacgcttacccgacaattggacgacttcgccagccttaaactgagcaatgtcattgtcgctagcatcccagaacttacctgaaatatgtcctgaattgtcttgaaaaatcatcgcaataaattttttgccattctttgcgacacgcacttcagctgatttaatcagcacaggaagccgaacatcttcttcattatgataatcgaaaagccgttttaccaaggtcgtcaccttttccttgaattttcacactacttaaatcatacagatatcaatgataaagtacaaggaaggttggtgcttgagtgtatgagaaaccatgcttcattgtcatacaaatgttaagcacatccaaggacgagtcagcgctcgagtaagagctggcacctaaccctttttaaaaataatggttggatactgcaaaagaaaatgcaccacctatgaattgccttttgccagcaagtttagttcaaacattgtcgcgacacgctcagccttctctatgcgcatgaatttccaaagaaaaaggatctccgcaatcaacggaaatccttcaatcaccagtcattacttgccttgatagacatcaataattggttgggaaataattttgttcaattcgtccatcatctgagataggccttgttcttttgccatcaaattttggatcggctggatgtcgcgcatcttgtcgccaagttcttgcaatgacttcacttcatcatccgtgaaatcttgtccctgcattgacttttgctgcatctcatattgcttttgttggaattgttggaacaaaccgtaagcaacggtgtccagcttcaagagatcaaacgccttcttgagatcctgaaattcctgtgttgtcttgatatctgccgccatctgattagcggtgtcgtaaacatttgccatactttacctcactttttgagcctatttaaaccagcccttgatattatcataccattgtcccacagtttgcttggcactgtctatgcctttctcgatactatcctgaattccttgccatgttttgtcgccactggatggtgtttggatgctagccatttgtgcggcatctttcgtgtcaaacgcggtttgtggcgtattcggcattaggttcgtcatttcgagtttaaataacggtgctaccccagacgtgctggtgccttgaaggaaatgctgactgtcggttgtcgggtaaccaatccaggtcgcatttacaatgtctggcgtataaccaatgacccactgatccttagtgccgtagccccaactacttgggacctcagtactgccagttttcccggcgattgtgtagccagctggtttagcagtttgaccggtcccttcgttaaacgttccgatcatcatgctcgtcatttcctgagccactttttttgatatgatttgacgcatcgttggatgtgagttgtcgaccaccgtttgacctgacgcatcgacaattttgcgaatgaagtgagtcgttggcaatttaccgccattcgcaaacaccgcataggcccgtgccatcatcagcggtgaaaccccatttttaaggccaccaagtgcagcagcaagattctgatcgctttcttttagttggatgccaaaccgatctaagctagtgacccctttttgtacaccaatcttattaagcagccaaacagccggcgcattgatcgaatcggccaacgctttatacatcgggacagtacctaaataggtgccggttgcattggtcggcgtataattatttttaccgtaactaagtttctcgtccttcaagacagaatcataatgataaccattttcaagtgctggtgtataaaccatcaacggcttgatcgtggaacccggcgaattgcgaagttgtgttgcgtagttaaaccctaagaaggtatgctcaccgcgattaccaacgaccgccctgacaccgcctgttttcggatcaagcacgatggaagccccttgaacctgcttaccatctgcggcatttgccggaaacgcccagtcttgagcaaagctgttttgaaggttgcgttgataagtttgatccaaattggtataaattttataacctttgttcaaaatatcatcgacactaataccttcactgcgcgcctcttcaatgacggagtcaaaataagacggatatttttgactgttggccgttgaaaaagtatcgacaacctgcactgactgcgcttttgccgcattggcctgcgcctgcgtgagcttcttattgtccaccatcaattgcaaaacgacattgcggcgcgacaaagcattgtccatgtgatcagcggggttatagtagctaggattccgtaacatccccgccagaattgccccttcactcgcatcaagctggctggcatctttgccaaaataccgcttagcagcatcttgaaccccccagaccccattgccaaaataagcattattgaggtacatcgcaagaatgtcttgtttggagtaaactttattcaactggatggccataaatagttcttgggccttgcgcatcaccgtctgcttttgcgtcagcaaggtattcttcgccaattgttgggtaatcgtactaccaccacccatgatttggccatggtggatgacataattcaaagcagagcgaagaatccctttgattgaaaaaccgccattggtataaaacgtacggtcttccgtcgagataacggcattttgtacttgcggactaatcgcctttaactcgacgtaggtccctttttggccgtacagtgtaccggcttcttcgttgttagcgtcataaatgacggtttttgtttgtaaggtactcttgatgttttcaacatcggcggttttggctttataagtaaaccaagcagagaacccgagcatgactgtcagaccaattaaaatcagccaacgaatcacctgaaaccggcggaaaaaccaccgtgttccctgccaaattcgtgataagaactgcatttccgtcctcctaatgtgaatcttgtttattgtagcataggcgacagccgccaaaatttcatcgacatctttttaagcaaactttatggtcaaatgaattgaggaaatcacttgttgtttcaaacttctgcacgtgccacgctgcccgccagccttcgcgatcaacttcaagcatggttgataccacgtaaacggcaacaccaattgcgcgttgccaaaacaattttagttaatggtcattatcgtaattttaatgaaaaagtacagcctagtgatgttatcacgatgacttatgatgaacccacgccacttgcctacgttccggaaacgccggccctcacaattcattatgaagatgatgatctactcattgtcgataagccggctggtatgaaaactcacccaaacttaccaggcgaaaccggtaccttaatgaaccaagcagccgcttatctggcccctttcccggcgttaattacccatcggctagatatggcgaccagtggtttattggtcatcgcgaagaaccctttaacgcaagccatcattaaccgacagttggctcttaaaaccatgcatcgggattatatagcgttagtaccgcagggaattgcggccagtggcaccataacggctccgattgggcatgatcctgatgatcagcgtaaacgcatgattagaccggacggggcatcggccattactcattttcgccggatcgcagaaacgtcaacaactgcgacggttgcgctcagactcgaaaccggccgcacccatcaaattcgggtacatttagctagcattggctatccaatcctaggtgatccgctttatgcccctgatcagacaacctatcagcgcatgtatctgcacgcctttcaggttcgcttcacaaagccgctatcagacacaacgttgacggtgaccagtcccctgcctttttgaacaattttgagccaaagtaatggcacataccatggcaagcagcgggccactaattgtgtgacaacgaaaagagctgggtttgacaaggttgaccttgttgcccagctcttttgcttgtgatgttgccagatggttacgaattgaaggcttgccgataagccgcttcaaaccattttgcctgcttctcatccgggctaatcacgacaatcgtgtcatgaccagcgatggtgccgacaacttgctcaaaaccgatgtcatcaataatcgctgccaataaattgccattgctcggtaacgttttgatcacgttcatgaaatgtacccgggtaattgacagcccgacttcgcgaattgagcggcccaaccgttctaactgggactctgaagaaccgcgaaaaatggtataacgtaacgtcccggttgcgtcttgcgatttgacgatcttcatctcgcgaatgtcgcgcgaaatcgtggcttgcgtcgcatcaataccagccgcttttaatgctgccaataactcttcctgcgtggcgattggcttttgattaatgattcgtgttaaggccgcttggcgttcacttttattcatcacatggcctccaccattattgttgcgcgggagtcagtccaggagacatcggcgtgtaagtgcccttagacgcgatggccgaactttgaccattgtgaccaaagtccttatgcgtaggtgtctggactaacgagcgcgttatcgtcactgccggttgctgacgcgcaaggttacatttcttctggcgcaccgacacccaacagttgtagcgcatttgttagcacttgtgtcgtcgccttaaccatcgccaatcgagctggcagctcactgtcctcaaccagcactttgacattggcataatacttattgaaagcttttgccaagcgtagtgcatacttagcaatcacagaaggttcatattccttggctgcacgcaagaccatgcttggataatcgccaagggcgcgcaaaacgtcccaagccgctggatcacttaaagccacttcaggcgccgggtcaatcgcagccttccgcaaaatgctattagcccgcgcgttcgtgtactgtacatatggaccagtttcaccttcaaaacgcacgacttcttctaagttgaagtcgaagttgtctaagcgttcgttcttcaagtcatggaaaatgacggcgccgacaccgacttcatgcgcaactttatccgcatttggtaaatcgggatgcttttcagcaatttgttgtttcgccagaccgacagcatcacgcaaaacattttccagtaagataatgttgcctttacgcgttgacaacttcttgccattcgccgtaatcagcccaaatggaatgtggtgaatatcattcgcccagtcgtaacccatttctaacaagacggcttttaactgctggaagtgttcgcgttgttcattaccaacaacgtacaggctttgaacaaaatgataatgttctttccggaaaatcgcagcagcgagatcacgcgtcatatacagcgttgcgccatctgacttcttgatcagcgctggattcaagttatacgcactcaaatccacaatttcggcaccttgactagttttcagcaaatgcttgtcttcaagtcgcttcaccacatcagccattttgtcattataaaaggcttcgccattgtaagaatcaaagtcaacaccgagaattttgtaaattcgattgaactctgccagtgaaactgtacggaaccagcgccaaagcgcaatggcttcttcatcgccatcttccagccgcttaaaccaagcacgggcctcatcgtccaactcgggatttgcctcggccttctcatgaaattccacatagtaatgcaatagatttttgatcggatcggctttgacagcgtcctcggatccccacttcttgtacgccacaatcagtttaccaaattgtgtgccccagtcgccaaggtgattaattttaatcggtgtatacccgattttgctgagaatgttggctaaggcattgccaatcacggttgagcgtaagtgccccatggacattggtttagcaatgttcggactgctcatgtcgatcggtacattcccgctgccgatattagcatcaccataatgctcgccagcttgcgcgatcactttcaacacatcgtgggcaaaactgattttatccagataaaagttaacatagccaccaacagccttcacttgttcaaacggggtcacatcaatttgaccgaccaaatcgctcgcaatcatctttggtgcgcgatgcatgatcttcgccaaggaaaaggttggaaaagcataatctcctaagtctgatgacttgggtgtttcaatcaaggacttgatcgcagccgcgtctaattgaccggcaagtgctggttcaagtgccttaacaacaagttctttaaaatccataacttcctcctaaaatgatgatgccacgaaaaaaggacccatctctcctgttcgaagagacgagccctagcccgcggtaccactctgcttgacaatatgtccactcaaagcactgattctcaaaagcgcgccatcaggtccgacgtgatcgtttgcactatccgatctcactaagaaccgccaactgaccttatttcctctttctcacagaaccttatacagcggtcgacgagaatcgaactcgcgacaccagcttgggaagctggagttttaccactaaactacgaccgcaaatcaacggatataagtatatcacgagggctacattttgcaaaggtcatcaaaggcgactttttctatgaatttgatgagaaaaaatcttaaaaatgagtaccggcaattttcttgttaatgtttctcaccgtgctataatattagtaaagaaggagtggtcgagatggcaaaaacgggacgtcactattatttcgtggcgcgcaacgagaaaaccaaaacaggttatcacattagttttccaaatattcctaacgctgaggcagtcgggacaacatacgaagagaccgtttattattcatatcgggtcttggctgacttcctgagccatctgccaaaacaagaagcggaaattcgtgcctacacgctttccgatattccggatacggtttccagcaatgttttctattcattggtgagcgtcacgcctgactttgatccgcacaaaatggaaacacattttaccttgccacaaacaccgcctgccgatattcgacaaaaggcagctaaactggctggattagtgacaccaaatgataacttggctttgtaactaggtattcaacatgcaaacttttcgaatgttgttgttagttatttttcttgttggcgttgggttagctttgatcggcctagtaagttggttgattgctctattgcgacaccgcgaaacaaaaccgatgcggcgactgacttggctgagcggcggagtggcgcttgcggcgctgattgtcaacgcgtttacgtaaacaactttgatttaaacgataattcttaagtcatcgtttcaaaaagagcactgccagtgatgggagtgttttttgtttggatttgagcggaattgtcgtgcaatcaaatcgagaatgacaattgaacgttgttgcttcaaaaacgcgttcgctgccgcagaaactggtgtgtaaggaccttggaagcaatgaccaaagcccggtcatcacgtccaaggccgcttacacgccggtttctaaacgcctcagctcacgctctgaggcgttgactggtttctattgtgtttctatgcttaaataggaacagcaaataatgaaggagtgggcttatgactgacctgcaaacaagtattggcgactttcaatttgataatgtgttcatgaacgcaagcggtgtacgctgctacaccgaggaagacttagatgcgttggcacaaagtgatgctgggacctttgtcactaaaagtgctacccaagcaaaacgcctcggcaatcccagcccgcgctatgctcgactagaactcggctctatcaattcgatgggcttacctaatgagggcctcgattactatctcaactacgccttgaagtttcaggaaaagcatccaggtcaatggatttttctgtcagttgccggcttgacaatggaagaaaatctcgccatggcacacactatcgaagactccgattttaatggcttggtcgagtttaacctgagctgcccaaatgttccgggtaaaccccaaaccggttacgattttgaccgaaccaaggaagtgcttaccaacctcttcacgttctttaccaaaccagcaggcgttaaattgccaccttattttgatctcgcgcaattcgaccaaatggctgccatcttaaatcagttcccgttgcaatttgtgaattctattaacagtctcggcaacggcctcatgatcgatcccgaaactgacacagcgttaattaagccaaaaggcggctttggcggtattggcggcgcctatgcgaaaccaatcgcactagccaatgtccgtgccttttcacaacggctggacccgaagattcagcttatcggcactggtggtgtgaccaatggccgtgatgcctatgatctcatcctcgccggtgcgagtttggttcaagttggcaccttgcttcaagaagaaggaccggccgtattcacccgcctgagccgtgaacttcaggctgtcatgcagaccaagggatataccaaccttagcgactttaaaggacaattgaaaacccaatgacgaacgaaaaaatgaaggtttgggcatactttaaacacaacgctggcgactttagccgactttggggcgcgtatatcatgctcatcagcgtcaccaatctatttattgggttagctgtgatcccgttttttaattttgctgctcagcaaacgttgcgaattggtcacgtgccttacattaccttgacgaacctcgggcaaatcctgactcatgatcccggggtcgctgcagttctcaccttgttggggctgctactactgttattcgtttactggcagttcaccttcttgattctaggcattcaaaacattcatcggcaaactcgcttaagcttctttcaattagcaatcgcgactttgaaaaaaacccgccgcctaacaccgacaaccatcgctgtcttaatcgcttactttgttttaatctttccattttcaagcgttattttcaaaacaagcttgctggccaaattaaccattcccgatttcatcgtcgattttatttttgcccgatggtatctcggcctactggtcatagcgctttacatgatgggtacctggctcgccgtccgcttgttgccattattacctgctttaattttgagcgaaacccctcctcgaaaagcggttgccaaaacttggcggatgacgcgcggccaaacttggcgcacattgttagcagtcttgttaatcttcataccggtagctgttctgaccactttgctgaccattggcctatatttacttcagtcatacttagacagtcactgggaacattgggccttacttggagccaccatcaaccttggtgtgttgcaagtggttatgttgctattaacagtgttctttaccgttatgctttatcaattgggaacctcgcaggcagagacatttcagctcattcccaaccaagacttgattgcccgagtcccaaaacgtcggcgcaatcttcttttccgaattggcgccgttggcttaattgcgttagtcatcggtggcagcagtcttttctactacgcttatctgactggtgcactggcaagtcagccgttaactatctcacaccgcggggttgatgatggtaacggagtccaaaatacaatcccagcgttacaagccaccgctaaagaaaaaccggattatgttgagatggatttgcacgaaaccaaagaccatcaatttgtcgtcatgcatgacgagaacctgaaagatctaaccggtgtcgatgccaaaccacatcagctgactttatcagagatgaccaaactgacagctcgcgagaatgggcacaccgccaaagtcgctagttttgaccagtatttggcggctgcggaacgactgcatcaaaagttattgatcgaaattaagaccacacctgaagacagtccgcaaatgatgaatcattttattcaactatacgggcaacgacttctagccgatcatgatcagttgcattcgctcgattatcaagttgtcacaaccatgcgcaaacgagtgccaaagttgaaaacttttttcattttgccgtatacgctcgtctttcctgaaacaccagctagtggttacacacttgaaacaaccacgttagccatgcgggtgattgacgaagcgcataatcgtgatcaaaaagtctatgcttggactgtcaatgacagcgatgatatggaaaaagtagctttcatggatgcggatgggattatcacagatcaattgggtgaattaaaagcaacactatatcaaatgaaccatcatccaagttatgccgatcagattttgcaatatctgacgagcttttctgatgatgctgaaaactagctatctacaaataaaggcatcaaaaaaggccatcaacttttattcgttgatggtctttttagtcatttacttgaagtaatacctagctgtttctaatgcgctggtttccatcaagcgtttgccatactcagacagcaccgctgatgacaacggtgaccgatcgccaaattccatcgcgacggccatttgatcgtgcgcctcgtcagacgaaatctcatttggataaaaggttagtaccagataataagcgttcttataacgataaagatcactctttccgccttcgagccgcaatgtatctgctaaactgataaaatcttcaaagtcctttaatttcaaaacaagctcagtctgtggtgctttgtcggcatcaatatagccgccttcatcaactgcctgatgatcttgttgatcactggcatcaagcccttgcagttgctgacgaatataatcaggcacctgggtatccgtaccttcgtcatcagtctgatcggctgcgctatcatcgtttttttgaccacttttactgatcagcaattcgagtccggactgactcggcatgacctgaaacgtcacggcttcatttgtagcaaacgtatgatctttatcgacctcatcgaggatactatagaagaagctctcaatctgtttatgattgcctaacagatccaaaaccgtgatcccacgctgcgctagatcatcgttgcctaacatgacccggatcgtatttgcgttaatccgttccatttccatgattgctgcacctcactttagtcacggaaccctggcttctgtgaatatcacattaccacttactacattatagcagatttcgtacgtcaaggcattctaccgcacgttagcgtgagtatcaagtaaagcgcgcggtcttcaaacttggttcaaccttcactctagtaacacttgttttatcaacctgcagtaacatcgcgtttgcgcctttcatacgcaaaaaccgcaccaaattaggtacggtttttgtaaatgattggctcattaataattagttttttaaaaacctgcaagtagttgtgcttgttgtagctccattgttcggacagaacgcggcaagaagcgccgaatttcatcctcgttataaccaacctgcagacgtttatcgtccatcataatcgggcgacgtagcaagccaggatacttggcaaccagcttaattaacgtaccagttgacaagtcatcaatattaatacccagctcctggaagattttcgaacgtgttgaaataatttcttcagtgccatcttcggtcattctcagtaaccgtttgatttcatctacgttcaatggatcagaaaaaatattacgttcctcgaatggaattttattttccttcaaccaggcgcgcgccttccgacaagatgtgcaacttggggatgtatataaaataaccattagcgctcgctccttttcgtgacgaggtacttttcatctctacaggtatagtataagagattggaccggcgctaagcaatcacatttagaaaaataattttttaaaagctgaaattccatattaacgaatattgactattgtccattttatcaacaattatgcttattcatttgcaataaataatacacgttataataacctcgatttacacatcttgttatcattttaaagtaaggcttatcaagagtatcagattgagattgtcaagtcatcctctgccaattgaattggtatacccccagcagcagtctgtgcttgctgtttcaaggtgacaagatcaagctgttgcggcaaatgtgtcaataataagcgctttacttgagcgtctttggctagttttcccgcttctggtgctgtgagatgccaacgcggttgtggctgatctgctagaaaattggtatctgccatcaaaagatccgcatctttagaaaacggtgccaatgccgggaaataacgcgtatcacttgtattgacaagtgttttaccagtgacgtcttcaacgattcgaacagcaaacgctggcaccggatgttgggtttcaaggaaagttaacgttaaagggccgagatgcaaagtgctgtctgccgtatagcctttagccgttgtataagggccaaacgttaaactggcaaagttcaacgggtcttttgtatgcccatatatcggcaacggtgacacctttttgtccccttttcgcaattgataatagtactgcaaaacaccgacatccgcgatgtgatcatgatggtagtgagtcaataaaactgcatctaattttaatggatcaaactgctgctctagtgaaagcaagccgccgctacctaaatccatcaataaatgatagtcaccactttcaataaggtaagtgctggtcgcgtgacccgcatctgggtagccgccaagataacctaaaactgtcaatttcatcttgtttttccttcctttcaatgtgaaaccattcaaaaagcttataatggatttggaggtggtcagaatgtccacaatacaaacagtcttcggcagcaagtcgttccttgtcaaactgctagacgaacgtcatgacccgcaattgaaactgttgaaaccagctgaagagggtttggattacatgatctatgaccccagcggaaaagcacacttttccgcgcccttgcaatatgaaacccttgcggatttaggtacgcccgccgacaatggttatattcacttcatgtactttaatttgagtagcgatgacgtgaaagttttccttgccaaaattaaggatctcattgataagcatgatatttttcttggtcagactcaagtcttagtcgcccagaaagtcaaacacccagacgactttgtggtcgtatcaggttggcaatccagtaacgactactacgagtttaagaatacgccggccttgtcagcagtcaaggagttcattcgtcgcgcggcctccgcaaacggcttccatcaggctggctatgcggtgattgatccgcatcagaaaaactaaataagttacatagacggcttgttaacgcctatgaaaaatccgaagtcaatcacttcggattttttattggcgcctaatgcgctttttaagaatgcactcgcttgtgtaattattcagatagcccacggatagcgccatagctaatcaatcgcccaacgggaaacaggttcatctaccatgcgggcagtaatgtgcacagttgcctcataaaaaagccaatcgataattgcatagatcaaaatcatcaaacccaaataacgcgaaggcggattatcaagataagttgtcaaaacactaatcatacaaagcccaattgttgtcccgaaaagaaacggtaccgcaaagacaaccgcagcttgccgataaatcgttatacggagttgccttggatccataccaagatgttttaaaatttgaaaatgtcgggcctcttggcgagctgcaatcacctgttttaaaagtaaaatgctacccgtagccacaacaaaaacgccgccgagcaataaaatcagaaagaacaaaaagccatacaaagtgttcacaattccctgctggaaggactgaattcccaacggattgcgccaaaagttcaaggtagtgctggctcgatctgtcactctcaaatcattgccatcccgctcagaactgccaatattgacatactcttgaagattttgactattctccaagtgctgtaattgtcgcaacgcagcggcggttgctttggacttaggtaagcgagccatatacaatcgatcagtcgttccttcaagcatgtcaaacgtccgatcactgacaagcaacccccggtcaaaaaaattgtttctgccggtcgggaaaagattggttgttcgtgttaacaataatgacgcatcgctacccggcaatatgatggctcgatcaggattgcggcgggcaccgactggtcggaaactggttcgcgttggcagcattagaagtgcttcgttcccacgaagtctaacaggagctaaatagtgctgtaagtgggcagcgcgttgataatcccgcatcgcaatcacattataaacaccaggttgttttcggacctgatcggcctgatctcttagtcgaatttcggcatacacaagtttcgaagataggataattgcttgagttggtttgaccttagcttttgctaaaattttcgtgacattatccacgcctgcccctgctgcaaccacagtcgtcggaatctcgcgctgaaccagatcctgattatattgaaacaacatagcagaactgccaagcatcgtaatcgtaatcgcacacagcaatgttgttagccacaatgaatgcgcgttcccttgaagtcgtttaatgatcaaatgtcttgagatggcatgcgcattgcgcgtcttcatttgacttcgttgctggaaccaagccactatgccaggcagaaactcctcaaaaacgaggaaaagtcccagcaacaaagccactagcatgaatcccattaacaatggtggaatcaaacgcccctgagttcgcggcagtatatgcatcaacacgccactaactggtaacaaatggaccatcgtaaacagactgccagccaacaaaacgacgccagcaatgccaagggaaaaccgccaccatgtttgcggtttgggagcggccgagacatcctgctggcgaataaaattacgcaatgggttttgaacataaatggcattgatgctgcccactaataggtagacaacgcccattaaaatcacgacatcaaccatagctgggaaagagagcatcaaactaatcggtgtgtgcaaggccatcaatcgaatcagcaccatgcccaataaaggtgagataatcaatccgagtatgagacccagagccattccgaatataccgatcattaaactctcaatacagactaacaatcctaatttggccccagacaaaccaagcaaacgatatagcccaatctctcgatcacgacgagcaatgagtaaagtgttgaaataaagcaaaaaactgatcgcaaaaagtgctaagaccatcatcacaatcatcaatagaatcggaacaatatccagatccccaagccgcttgctggcatcgctcaaaatcggttcattattcgcaaccgccccaatggcatacataacggcactgatcaatgctgccaccagtacctgcaagccatcctcgtgacgatggcgccgtaaatttgtcttaatcagatgccacacgggtatggcctcctccactgacagttgcttccatatcaataattcggtcaaaaaactgctggcgggacttaccacgcgttacttcagcaaaaaatgccccatctttgatgaagatgatgcgacttgcgaagctcgcggtgaagggatcatgcgtcaccatcaatatcgtggttttttctttttcgtttaattgacgcagatagtttaaaaaatcagttgctgctaatgaatcgaggctgccagtcggttcatctgccaacaaaagatcgggttgggtgatcacagcgcgagcagccgcgacgcgttgtcgttgtcccatacttaactcccccggaaaagcctgcagaatgggagttaagttaaggtgattcgcgactgtctgtaatcgttcagcacgatcaggctgaagatcttgctgcaaggttagcggcaacaaaacattttgcgtcactgtcatatcatctaataagttgaagtcttgaaacacaaagccaagatgatctcgacgaaaagccgcttgttgtcgttcattaagggcctcaagatcgttccctgcaatattgacttttccggtacttggcgtctcaatcgttgctaaaatattgagcaatgttgactttccggcgccacttggtcccataatgccgacgaactcacccgcgttgacctgaaagctaaggtcgttcaaagcgcgaactcgatcatgccgttgtccaaaaatcttgctcaagttagatacttcaagaattgccatcgcgcacctccgccattatcataccaaaaacgtgttatgcatgtgctgccaactcccgttagacaaagaatctcgggtttgttgctcttagtttacattttaaagtaaatcctgaaaacttatttattagaagattgcggcttcctaaaagccggacaaacccagctcataaaaactggtctcattgaccttgttcgcgcttgtgcttccttcccaaaacttataccattagagcagaaatggagttggtcacgtgtttaaaatcatgatcgtagaggacgatcagacgattagtgggctgatcgctgataacttaaaaaaatggcaatttgatccagttgtggtaaccgattttaatgctgtatttgatgactttttgcaagaaaaaccccatttagtcttattggatattaatctaccagtttttgacggctattattgggttcaaaaaatccgtgaagtatcaaaggtccctgtgattttcatttccagtcgtaacacgaatatggatatggtcatggcaatgaatatgggcgctgacgactttttgaataagccgtttgccatggaagtgttgatcgccaaaatcaacgccttgcttcgacgaacctacaattatgctgatcaaggaaccgatgttttggaacacaacggcttgatgttgaacctcaaaaacggtatggcacaaattggcgaaaacgaaattaacctgtcaaaaaatgaatataaactgttacaaatcttgatccggcaacacggtcaaatcgtcagccgttcccggttattaaaggacttatggcaagacgagcgatttgttgatgacaatacacttaccgtcaacattaatcgcttgcgcaaaaaaatcgaggaagccgggttgaaagattatattcaaaccaaggttggacaaggttacatcgttccttaggaggctggcagatgcggtttcgtgattatttaaaggatcatttaagcccgattggtggctatattctttgtgttggtctggcggccttgatcatctggcttgacccgcagcatcgcgttaaggccatgacgctttggtacgctgtgttgttagtgacactattggccagcgcttttttgatcgcacggtattggcgcgtacggcggttcgcagctcggcttcaggaacggatcgatgctcaggaggctgcgttagactggcccttgcctggcggtgaatccgcaaccgaacaacttgtgacgaaaacgtacaatcaaattttgacccagcatcgccaacaagtaactgccctgctagcacaacagcaagatcaaaaagacttcattgattcttgggtgcacgaaatcaaagtaccgctcgcggcagtgacgttgctggccgaaagttttgaggggcaagtacctgatgacaaactggataatttgaatctgcaattggatcaaatcgaattttatgtcgagcaagtcttgtattactcgcgtctcgacagcttttcaaaggattatttgctgcatgagacatcattgcgcccgctcatcaatgacgtagtcgccaaccagcggaacggctttatcaataaacgactatctttcagactgaatggcaccgatcaaatcgtattgacagacaacaagtggcttcgctttattcttgctcagctcatctccaatgcggtcaaatatacgccagaaggaggccgtatcacggctctcattcgtaacactgggaaggaaacgcaactacagattactgataccggtatcggcatccccaaagatgagcaacatcgtgtttttgagaagggattcacgggtagtaatgggcgcctttcgaatcataagtcaacgggattaggattgttcttggctgaaaagttagctgaaaaacttggccatcacttgtcgttaacctcggtaatcaatcaaggtaccacggtcacaatccattttccttacgtgagctattatggtgaggccgatcaaactgtgcaccatcctgaatcccacgcgattgctttgcaaacccagactaggtcacatccagacagctgacgaataagatagcatcaagtcgttgaatcaaccctagatctcaaaattgagagccacctattcaacaaaatcggcaccaaaggcaagcagcctctgatgccgattttttaatagattatcttaatgtctttcgaattgcctgaacgaactaacgaatcagatttttccacaacttgacttcgccagccgccattgttgctggtacgtcaatgatgcgctggttagcactgccacgaaactgtaaggtcagatccttttgcgccaacaaaaagcgaccgtcaaccaaaatatcgatcaattttagcaactcaagtttatcgtctgaatcctgaatcaattcatcatacgtatagccgctccagctccaaatgtctttctcatgcccgaattcttgacgaattcgtttgcacaagcgaatgcagacttgcgtgttgaggaaaggctcgccgcctagcagcgtcagaccctgtacgtaactttgactaagatcggtcatgatttgatcctcaagttcttgtgtataaggtttaccataacgaaaattttgtgcaacccgattgtagcaaccagggcaagcgaaacggcaaccggagacatataaactacaccgaaccccttcgccgtcaacaaagttaaacggtttgtaatcggcgatgcgttgctgtgaaagctcactggcaagccattctttaggtttgggattttggggtaatttattttcgatcatatgtctgccttccttgagggtgcgccaacccacgtggtgtcacgcaccctgctgtttagtcttatgaatccacttttttcatcgtatcacgtttcacccccaagatgtagtatcagttgtacacaaaatgccggcctgtcatctatatcttgacgacaggtcggcattctctgatgctatgcttcatacacgtgacttattaagcgcgctttaagtgcagtgtcattgcattcaaagccacaacaatcgttgacaacgacatgatcgcagcaccgaccgcaggactgagaatgaagccaacgggggcaagaatccctgcagcaagcggaatcgccagaatattgtaaccagcaccccaccaaaggttttgaaccattttccggttagttgcttttgccaatgacaagaagttgagaatatcagccgggtcactatgaactaagacaacatcagcggtatcaatcgcgacatccgtcccagctccaattgcaacaccgatgtctgcttgagccaaactaggcgcatcgttgaccccgtcaccaaccatcatgacaacgccctgctgttgataagccttcacttgcgcaactttgtcttcaggttttaactctgcctgaaattctgtcagaccaagctgactggccactttcttagcagtttcatgattatcaccagtcagcatcacaggcgtaatcccctgctgtttcaactcggcaacaaatgccttactggaagacttcaactgatcgccttcagccaccatgcccaaaacgtgctgacctttcagcaaaaaggctaacgaatttccggcagcagcccactgatcagcctgggttttatcgtaggtcaactgatgatcctgtaaatatcgggcattcacaatctcatactgaatgtcgtcgactgtgcctgacagcccgacacccttcatgacctgaacattttcagcagctggcactgttagcttttgctcaattgctgccgctttaatcccagttgcaagcggatgctcggaatgactttccaaggcggccatggttgctagaatttcttcctgactctgatcagcaaaatgcaacgttgtggcaaccgtaaacttgccttcagtcagcgtccctgtcttatccattagcatgtacttggctcgcttggctgtttcaagcgcttggcgattgcgaatcaacaacccattcgtggcgccaatactggtactccgagcaatgacaagcggaatcgccaaccctaatgcatgtggacaagcaataatgaagacggtgaccatccgttcaaaagcggtggccaggccgcttggcatccagagaataaatgccagaataccaacagctaacgcagcatagaacaaccagccagcaactttgtcggccatgccctcggccttacttttatttgcttgcgcactttgtacaagcttcattacttgggctaaatagccgctttcaccagtacctgtcacttggatttcaatgaccccatctccgttgatggaaccaccaataactttatcaccacctgccttacgaacagccttggcttcgcctgtgacaagcgattcattgacactactgctgccgcttacgatttcgccatcagctggcatttgttcaccggccaaaacccgtaatcgcgtgccaacctgaacctctgacaatggcatatccatcacactgtcgccatgaaccacatgcgcctgatttggcaataatgcagccaatttttcaaccgcattaccagccgccatcacagcattcatttcaatccagtgacccagcaacatgatcacaattaaagtggccagttcccagaagaagtccatcaccataccatgtggggcgataaagtgattcatgacgaaagcataaagcgagtaaccgtacgcaacggtgatccccattgcgatcaaagtcatcattgcgggctggcgactttgcaactctgatttagcgccggtcaaaaatggccaaccgccatagaagaaaagaaatgacgaaagaatcaggacaagccaatcagacccaggaaaaacaattggcaattgcaaaacgccgaggtggatatccatccccatgaactgcgaaagcaacaacacgggtatcatgacgatcaaactcacccaaaacttttgcttgagatttcccatatgcatcatgtgacccccgccatgatccatcgcgccgtgatccatatgcatgtgatccatcgcgccgtgattcatgtgcatctgatccattgctgcatgatccactgaacccggttccatctgcatcttcgccatgccagcatgctcttcttcagagtcgtgatccatgtgcatgtggtccatatcgccatggtgacccatcgccatatgatcgtgattcatttgatcttttttgtcagtctgtgatcttttcgtatcgttcatcgctttcatttcatcgtcattcatgtgcagcctccttacaaccttctggtaaacaattacaactaactgtttccggcgcatcgtgctgcttcgctaaaagcgtttgttgcaacatctcaatatcatgtttcgaaagagtgacgttcgtcatcaagtgattgatggccgtgccgattttcatttgacaaaggtggctaaataattccgccacggcggcatccatagactcttgttcacccactgcagtgtgataaagaaattcacgtccatttttttcagtggttaaggcgccttttttgactaaccgtcctaaaaaggttttggtcgttgccactttccagcccattttttcagcaagaattgttgcaagcgtgctacttgtcagtggaccaagtgtccagataattcgcataacctcccattcagactgggaaatttcaactttcggtgtttccatcgcttgcctccgtttacatctgtaatctatcaacatctttaatttacaactgtaaaccataaaagtcaaccacagtttcttgagcgcacaaaaatgggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaataccagaccataatatcaaagttgcctttgttcgtcatgaatatcgcggcaacggggtacgtcgccgccagtatcatgtgattgatgccgagctgacttaccggttaacccggtgcccactgtgtggctttgaggccttgcaccctaacgggttttatacggcccacgtgcgcgtcctcaatggggttgaaatgccgacagtcattgacttgcacaagcaacgatggcgctgtcataactgttaccacacagtcagtgccaagacgccactcgtgcaacccaaccacacgatcgccactcacatgacagagcgaatcatgaagttagcgcatgaacggttgccagtcaaaaccatcgcccgtattatcggaatctcagcttcctcggttcaacggatcattgaccaaaatctcaaactccgaccggctcgccggctgcccacgcgactctgctttgatgagttccgttctactcatggcatgatgtcgtttatctgtcttgatgccgattcacatcgtctgattgccttgcttggtgatcgattcaaccgcacgattaaaaacttcttcatcgctcattattcactcgctgaacgcactcgggtccagacggtcaccatggacatgaatgcagcttatcagacgattattcatgaggttttccccaaggcccaagtcgtcattgatcggttccatatcattcaacttgcgactcgtgcccttgatcaggtacgcgtccaagcgctcaaacagcttgatgacaaacacagccgtccttataagatcatgaagacaaactggcggctttttcatcaaactgcgcctgacgctaaacacaaacagttcctgtttggtttgaatgaatacgtcacgcaacaggaggccatcgatatcgcacttgatactgagcccaagctcaagcaaacctacgagacctacttagcgcttcatgatgccttgatggtgaagaaacatcccacggaactggcaaacctgttagctacttacgagccaaacggtacggcaatggacatgacgatcgcgacgcttaagcgacacaaagtcgctgttctcgccgctgtcaccagcccttattccaacggtccgatcgaaggggttaaccgcctcatcaagtcactcaaacgatcctgttttggcttcaagaatcagctgaacttcttcaaacgaatctaccaaatcacggcataacatgacaaagacggctctccaaatggagaaccgcctcaaatgataaatttattcttcaacaccagttgacgtagagccacaaaataccccggctagccagccgaggcgcgattgtattcattcacttttacagtgtgtggaacccaatatcagtgcgataatccaaaacgccttgaattttctccatggctgtttttgccgctttaacggcatctggcaaagactccgccccagctactacggagaagattctaccagcgtgactttcccagccgtggtcacttttcgccactcctgctggcagccaagttccctctggccaatctgtcggcacaatgacgggaactgtcttgagcgcgccgcttgggtacgcaggattaacggcaacaaagcaagcataggccttatcgctcaacgtcaaactaggttggcggtttgctaataagtcgctaatcagttgataaaaatcatttgtgatttgcggcagcaggacttgcgtttctggatcgccaaaacgcatgttatattccaaaatcttcggtccgtcaggtgtgaagatcagtccaatgtacatgaccccttgaccatctaagccatcagcctgcatgccctttaacgttgcatccacaagttgatgggcagcggttacttgatcatcgttaaattgcggtaacggactaatcgcccccatcccgcctgtattaggaccgcgatcattggcaaaacgccgcttgtgatcctgagaaagcggtagaacgacacgcttttcaccattaaacaaggccatgacagaggcctcttcacccgcaagatattgctcaagtagcacggttgcgtctggatgatcggcatacattttttcaatcgtttcatccagcgtttcagcgtcttgagcaataacgacgcctttcccagcagccaaaccgtcctttttcaagaccaatggcaagcccattgtcgcggcttcggcatgggcatcaatagcattgtgaaccgtcttgctggcggcagtcggcaactgatggcgcgccataaaatccttggcaaacgttttgctggcctctaactgggcaactttcttggtgacgccaaaaatcggttgatcagctgcctgaaaagcatcaacaatcccagcggctaacggcacttcaggacccacaaaagtcagatcaatttggtgggtctcagcaaagtcaatcaacttggtaaagtcattgtcatcaatgttgatcggatcaactcccagcaagctcattgccggattacctggtgccacatagacatgatcaacttgcggagactgtttgaattttaaagcaagggcactttcccgggcgccgccgccaatgatcaaaacctgtttcatcgtaacctcctagtgtatttgctggtggagaagctttttaaacgcgtctgtcttttctcttaaatgcgctcataggcgcggaaacctatacatcagaaccttgaagctatctggccaaaacccagccagttcaccttaaggccacttatgctccggtttctaaacgcgcctgtttttctcttaaacgcgttctcaggcgcagaaacctgcacataaggaccttgaggtgaactggccaaaacccagccagttcacctcaaggccacttatgctccggtttctaaacgcgcctgttcacgctcttctttttaatgtctaaaatgacggacaccagttgtcaccatcgcaatcccgtactggttagccttttctatagaatctttgtcccgaatactgccgcctggttggatgatggctttgatatcatgcttagccgcgtagtcaacgcagtcgtccattggaaagaaggcatcactggccatgacggcgccagcaaagttgtcgttttgttgggcctgggtgagggctaactcaaccgaaccaatccgattcatttgtcctgccccaatgcctaacgtctgatcagcttgggcaacaacgatcgcattactcttcacgtgtttgacgactgtttgcgcaaaagcaagtgccctgagctgctcgtctgtgggtttcaccgttgtcacaacagtcatatcggccggtgtttctgtctgattgtcccgcgtttgaatcagtaacccaccataaattgctgtcgtctctgttcctaattcagccggcgtatcagctgtattgattgtaagcagccggacgtttttctttttggccaacacagcataagcatcatcatcaaatgccggtgccataatgatttcaagaaaaagtttgtgcattttttcggcagttgctagatctacaggccgattcaaggcgatgatgccaccaaaaatcgacatcggatcagcagcataggctttgtcccaagcgccttcaatggtttttccaagaccaatgccacaaggattcatatgtttgacagccacaaccgctggctcggaaaattcacgaagcatcgctagcgcagcatcagcatctttgatgttgttataggacagttctttaccgtgcaactgcttggcagcggcaaggctagttggattcggatcaggttcaacgtaaaacgcagcttgctgatggctattttcaccatagcgcaaatcttggcgctttgtgtaagtcggtgtgaagtgctcgggaaatggctcaggatcaagataatgcacaatttgagcatcataagccgctgtaatggcaaagaccttagcagccagcttttgacgcagatgagcatcgtcttggtcaaggccggttaaaacagcctcgtaatcggccggatcaacgactgcccagacactgtcgctatttttagctgctgcacgtaaggcagaagggccaccgatatcgatttgttcgatagcttctgcccttgtaacatctgggcgtttgattgtggcggcaaacggatagagattgacacaaaccaaatcgaccggttgaatatcgtggttagctaatgcctccatatggtctggatcatcacggcgtgcaagaatgccagcatgaatctttggatgcagtgtcttcacccgaccatcgagcatctcggggaaaccagttacctcttcaacgctggtcaccgcaataccggccgcagccagttcgcgatgcgtgccgccggttgagactaattcaaatcctcgatcaatcaaacctttggcaaaagagaccaaacctgttttatccgaaacacttaacaatgcacgcttcacttaaatcgctccttcttgaatgaggttcttcacagttgcagggaaaatttgatgttcttggcgatggatcgcctgctcaagctcggctaagctcataccatcagtgatattgactggcacttgggcgataatctcgccggtgtcaataccagcatccacaaaatgcaccgtgacgccggtgactttcaccccatagtcgaaagcatcctgaataccttggcgccctggaaaactaggtagtaaagctggatgcaagttgatgatttttttagggaatgcccttaaaagggttggcccgatgatacgcatgtaaccggccaaaatcaaggcagatactggtggtaactgttctaagatggccgtctctgccgccgttttattaggatagcttttaaaatcaactacgatcgtcaaaatgttgcgcgcggcagccttttgaatcaccggcgcctgtgattgatcacaaaccagtgcggcgatgcgatagccgctatctggttgatcagcggcattttccaacgcctcaaagttggtgccataaccagatgcaaaaacagctagatctttcatcgacgactcacctgccagtgcagcttttcgacaggatcttcgtcaaccgtgccaatcactttactgctaggaatctcgtcttgaacaagactaaccgcttgttctgccacgacaaggatcatgccaattccaagattgaaggtactacgcatcgttgtttcacttaaatgtccggcatgttgcaaacgatcgaacaactctggccgttgccatgcttgcggatcaatgtttgctaccaaaccgtcaggcatcacccgtgggagattttcggtgatgccacctccagtaatgtgagcggctgcgtgaatcaacccttgctgcatgagcggcaatacctgcttcacataaatgcgcgtgggccgcattaatgcattcatcatttccgaaccgtcattaagcgattgactccctaagtcggtctctgccaacagcttgcgcaccagtgaataaccattgctatggacacctgaacttggtagcccaatcaaaacatcacctgccgccacttgttgtggtagacgttttgaagcagctaccaaaccaactgcgaaaccggccaagtcgtaatgatgttgcggatacatatctggcatttccgctgtttcgccaccaattaatgccatttgagcctgctgacacccataagcaattccgcgaacaacggcttcagcgcggtcaacatccaaatgatccaccgccatataatcaaggaaaaaaagtggctgggcgcctgacgccaataaatcgttcgcaaccatggcgactaaatcaattccaacagtttcatgcgcatcgcattgcaatgccaacagcagcttggtgccaacgccatccgtggcgctgatcaaggttggctccgaaatctccggcaaccgataagccgcggcaaagccaccaacactagctaaaacattggcattggttgtttcttttgccaacgccgcgattcgttgaacagctgcctcgccagcttcaatatccacgccggcgtctttataatcagtcatgcactaacctccgcaacattgactttgagggatgccacttccttatccaaggcaaaggcataatcatctaacggtgctggatactggccggtgaaataagcgacacacaaaccgccattaggtgccgtggccgataagccgacactctcttccagcccctgggttgaaaggaatccaagcgactcgaccgctaaaagatcccgcatttcagcaacgctatgattcgcagcaaaaagttcgctggtcgtctgaaaatcaatcccgtaaaaacaaggaaagcgcaacggtggactggcaatacgtaaatgaacctccgctgcgccagcctctttcaacaacttcacgatttgtttggaagtcgttccacgaacaatcgaatcatcgactaaaacaattcgcttgccggcaacaactggtttgatcacactgagcttcattttgacgcttttttcccgcaatgcttgtgtcggttggataaaggttcgcgccacatactgacttttcattaaacccatctcataagggattccactggccttcgcgtaaccaatggcagcagacagcgatgaatttggcacgccgacgacaatatccgcttccgccggttgttcttttgctaaccgttcacccatccgtacacgggcttgatgcacattaatgccgtgaatatccgaatcggggcgggcaaagtagatgtattccatcgaacaaacggctaattgggtattcgtggtgaaatgatcaatgtgcaaaccagcatcatcaattgtgattaattcccctggctggacatcacggacgaattcagcgccaaccgcgtccaaagccgctgtttcgctgcacacaatatagccgccatctgacaacaccccgacaaccatcggccgaaagccatgcggatcaactgcggcatataaaccatgttccgtcagtaagacaaacgcaaaaccaccatgaacttcatttaaagcggtcttcaactgtgtcagccaaggcttgccaacttgccgtcggatcaaatgcatcaaaacttccgtatcggaggtggactgaaaaattgcgccttgatcttccaactgccgccgcaaactgatcgcattggtcagattgccattatgcgccaaggcaatggcttcatccgaaaaccggaaaagcaacggctgaatattttccagcacgcgtccccctgctgtcgagtagcgcacgtggcccaatgcggcgcgtccgattaatggcgtcaattgatcggtattcgtgaaaacttcgctcagcaaccccaacccataatgccgccgcatcccgtctttggtcagcccaacaataccggcgccttcttgaccgcggtgctgtagtgtgtgtaacccaagatgcgtgatgctggcggcattaggattaccccaaacaccgaaaaccccacattcttcatttaagccttttggttcatgtggcatgggagcgcctcctcgaatgctgtctgtagctgttgcaacgatgcagaaaaatgttgattaacggttgtgacttcaaattctggtgcggcctgaactcgaccaatcaattgggccggaccatgcaatgcttcaaatgctgcctgattttcaggggacacggtgagcaagaagcggccttgcgtctcggaaaatccccaagcagtcggcaatgtgacgttaatctgggcgccaagttgggcatcaaaccccatctctgccaaggcgaccaacaacccaccatcgcttaaatcgtgcgctgcagtaattagatgctcgcgaatggccttcaaaacaaagtgctgatgctgcttttcagcctctaaatcaaaatcgaacagcttgccagtgacttctcctgtttgcagcttctgcagttcgctgccgttaaaatcaccatgagtctcccccaccagataaatcagatcatctgcttgcttgaaagccgccgtggtgatcgtgctcaaatcctcaatcaaaccaaccatgccaatcattggggttggatagatcgcctcaccattcgtttcgttatacagcgacacatttcctgaaataactggggcgttaaaggctttggtagccgcaatgattcccttcgccgcctcagccagttcgtagaaggcctcaggcttagttgggtcgccaaaattgagacaatcggtgattccaagcggttccgccccgctagcaaccaaattgcgcgcggcttcagccacactcattgccgcacccacctgcggatcaagatacaagtaacggcccttactatcggtggtcatcgccagtgctcggtgagtaccgcgaatccgaatcacggctgcatcactgcctggcaagacgacggtattagtttgcacctgcgcatcgtaacgcttgtacaaagatgacttgtcagcaatcgtcggcatcgccatcatgtccgtccatatttgcaccggatcagtgatgatagggtcaaaatccgcagccggttgggccagtcgttttggcattttcccttgttgatgataaatcggcgcatcatcggtcaacgaactcacaggcacatcgcaaaccaatttgccatggtgataaagctgatactgatgaccagcaatcacatgaccaacaatcgccgcatccaaatcataatcagcgaaaacagccaaaacttcttgctcaaagccggctcgaacgcacagcagcatccgttcctgagactcagacaacataatttcaaacggcgtcatttcggtctcacgctgcggaatcaggtcgagatctaacaccatcccgctgttagccttaccagccatctccacgcttgacgataccaatccagctgcacccatatcttgaataccaacaagcgcctcctgatgatgcccggtaatttcgagacaagcatccatcaacagcttttccatgaagggatcgccaacttgaaccgccgagcgatcggctgcttcttcgtcataaaaatccccagaagcaaagctcgcaccgttaataccatcacgccctgtcttggccccgacataaatcaaagcattgccaacaccagcagctttacctttttgaatttgatctttgtccatgatgccaacgcacatggcattgaccagcggatttcgggtatagctcccgtcaaagtttgtttcgccgccaactgtcggaatgccaattgcattgccataaccgccaatccccgcgacaatccgatcaaccaaatgttgggtatgtggctgttcaatgtcgccaaaagctagcgagtccaacatcgcaaccggcttggcaccaattgagaaaatgtcgcggataatgccgcccacacctgttgctgcgccttcataaggttcaactgccgagggatgattatgactttcggctttgaagaccactgctttgccttcgccgatatcaatcacgccagcaccttcacctggccccattaacacgcgctcatttttggtccaaaattggcgtaacaccggcttgctatatttgtaagcgcagtgttcgctccacataccgctagctaacccgatctcggtatcgtttggctgatggccgattagttctgcaaaacgatcatattcagcctctgtcagcccaaggtctaaataaggtttctgggttgcaatagcctcggggctcatctcaacgtgcaccacgtacatcggctccttccgtttggttaatcagcgattggaatacgcccaagccatccgtaccgcccagcagtgcttcaacagcccgttccggatggggcatcatgcctaacacattaccagtctcattggtcacaccggcaatatcgtgcatgctgccattagggttatttgcataacggaaaaccacttggccattagtttctagagccgccaacgtttccggatctgcgtaataattgccttcaccgtgagcaatcggtaatgtcaaatggtcaccaacttggtattgatttgaaaacgccgtcccggcattttctaccgtcaatgcaactggttcacagatgaagttcaagtcgcgattccattgcaaggcgccgggaagcaaaccggcttcggtcaaaatctggaaaccgttgcaaatgccaatgacatagccgccagccgcagcaaattgctttagggcatccatcactggtgaaaagcgcgcaatcgcaccactgcgtaagtaatcaccataggaaaaaccgcctggcaccatcacaacatcataagcagtcaagtcggtttgagttggcttgatcaagtcacactcggctccggcaatgtcacgcaccgcccattgcaaatcaagatcacagttcgagcccggaaaagaaatcacagccgctttcatgcgttaacctccgccatcggttctagctcaaagcgataagtttccatgttgacgttagccagtaattggtcgcagatcctatcgacttgcttgcgaacgtccgcttcgctgcctgctaacgttaattcaaagtacttgccatacaatacatcttcaacattgtgataagccattcgtcccaaagcagttttaatgacctcggctttgggatccagcacggaaggtttgtaggttacgtaaattttagctttaaacatgagcagctcctttttcttgcaggcgtgaaaggacttcttcataaaccggggtcaatggtccacggttttgtcggaaaacatctttatcgagcgatgccccggtttgttgatcaactaagcgaaaattatccggagacaattcatcagccagtaccaaagtgccatccttgagcgtgccatattcgagtttgaaatcaactaaggtgatcccaatcgccgcaaaccgttgcatcaaataagtattgatgcgatcagttaaagcgcgcacttgcttgagctgttcaggcgtagcttcgtgcaaagcgaaaatttgggcttcattcatgaacgggtcgccaagttcatcagacttgtaatagtattcgtggattggcggatcgagcttcatcatcggcttgacattgaacttggtgacaaaatgaccggatgcataattacgcacaactacttcaagcggcaacatcgcggcttttttgacgatcatcgtcgtgctgtccggcgaatcaagataatgcgttggtataccgacagctgtcaattccttaaacagtaacgtcgaaatggcccgatttaattcgcctttgtgcgcaatctgggcttttttctcgccatttaatgctgtggcttgattggtgtatgccatccacaacacatcaggatcatcggttgcataaacctgctttgccttgccggtatacaataatgttgttttgttcaccatgctgcctccatttgtttaagtatgtccaacacattacgatcatcagttaccgtaagatgacccattttgcgaccggggcgaatttcggctttaccataatcatgcatgtgccattcaggatgctgaggccatttctgtttggcaatggttaaatcgtcgccgagcaggttgcgcataaccgctggctgcttcaatgtaatcggcggtatcggtaagccacaaatactcaaaatatgtgcatcgaattgtgaaaagttgcatgcctcaatcgagtagtgtccggaattgtgcggacgcggagccaactcattggccaccacattgtccccttcgataaagagctcaacgcccaacacaccacgaagatccaggccaagcgcaattttagtcgcgagatcatcaatctttttggctaacaccgacgagatgttcggtgcaggcgcaagcgtgagatgcaaaacatggtgctgatggcgattctcaacgatcggaaaaacacgcacttgatcgcggccatcacgtgtcatcataacggagacttcacgatcaaattgctgccgtttttcgagaatgcaaggaccatgcgtcaaaagttcgcgggcggcgggaaaatcatctggtgtattgatatcttgctgaccatggccatcataaccgccagtggtcgtcttcaggatgcttggtaagccgatggtcgcgactgcttgtgccaactcagcggcacggttgacagcggcaaaaggcgtcaccggtaccccatgtgtctttaaaaaagtcttttctttgatccgatcgcgggttatcgccaaaatggcggtaccttgaggaatccgcgtctcgctgcgaacggtttccaacgcggctaagtcaacattctcaaactcatatgtgagcacatccgacgcatctgccagttgctttaaggcggcttgatcattgtatggggcagtgatttggaaatctgctacctgaccggctggcgaattgggtgtcggctctaaaataccgacgcgataacccatcgacttggcgctttgtgtcagcatgcgtcccaactgaccgccgccaatgatgccaattgttgctggggacgtcactacatcaatcattgaagcgcggcctcgctttctttggcacgcttagtttgagcatcgcgaaaagcttgcagtcggtcagccagttctgaatcgttcagcgctaaaatagcggcagcgaacaacgccgcattgacagctccggcatcaccgatggccatcgtgccaaccgggactccgccaggcatttgcacgattgacaggagactatcaaccccatttaatgttcgtgttttgatgggaaccccgataactggcagcaatgtattagcggcgagcattccaggtaaatgagcagcgccgcctgcaccggcgataattgcaccaaaccccagtgccactgcctgtttaccaaaatccgccagctcgtctggcatccgatgagccgaaataacccgcttctcataaggaatagccaatgacgttaactgagccgtcacttgctgcatggtcggccaatcagaggttgaccccatgaccactgctactttttgcatctcgttccccgctttctttaagatgttttgagaatagcacgtcagcccgacagattcaataaaaatgagaacaattctcaatgttatattaataatcgttcgtgtttatcttttaaaatcttaaccagtcagcttttcaatgtctgaaatcacatctgtgttgctaatattccttttgacaacttattgcagtcgccatcgccaaaggctgctactcgcgcacaaaaaaacgcacatcacagagcgatgtgcgttcatcagatatgcgttgttgaagtcttaaacttaggcagccttcgttgaaaatgatttgccgtccttagcaacaaagagttgcggggcaacggttagcaatacaccaacaacaacaattgttaagacagtgctgaataacgctgatccaccattgacgatcaacgagtatacccagacattcgttcctttaggcgcatacgcaccccagaaaacaacgccagcgatgaaatggataaagtatttagcaaacgtgccgataataataccagcaaagacatagccgctcgccttcactttttcactaccgcgcactgccttttggaaagatgcaaacgtcaaccccattacaccgaccaaggtaaacgcaatcggatattcaagaataccttgtaaaggattcaagacactgccgccgccaataccacgcaaaatcagatccaaaatcccccagacaaagcctgcccatgctgcaggaactaacccacgccgcatagccaaaacagcaattggaatcagaccataattcaattcaattgccgaaacacccgtggtatgtggaatataagtcaatgccatcgcaaaagctgcaatgatcgcagtttccaaaatgacaacaagttgcttgtgctgttgcataaaaaaagcctcctagtgagtccccgttcacaaagaaggtcgcttccgaccattcacaaatccctacgctcgcattaacgaacaggttcgaagggtccgggtttccccgttctcagccaatggctcccctttgtgaaggttcatcgaattgttgatacacctttatggtatcaaactttttgtaaagcgcaactttttggtcttgaacaaatcgcttgtcattaatgatttaagcgggctttctcctctcggtgcaaagtttcgagggagcgtccagccgtttccggcacaaaaatcagaacgaaaagcaatgaaatcaaatttgtcccgatgaagcaaacgaatgtccagaacatgcctatttgggccagaccaatcgggaacagaacgccaacaccaaagttagctaaccacaagcagaaggttgcagcgcccatccctatgccccgaacctgttcagggaagatttcagacatcagcagccaagtcattggactgatagcgccttggaagaacgccaagaacagcatcatcatcccgattgtcgcaaatgcccggaatggcgaacccgctggtagtcgactagcgaaggtgacaccagtaatcgccacggttgagccaatcaatcccacaatcagcattggccgccgcggaacatgcttcaacaattgcaacgtcacaatcgttgcagcaacggcagtaaccccattggcaatgttggcgatcaaggcgctatctcgcccaaaacccgtcatttgtaaaattgaggtgccataatacatcatgacattgataccagcaatttgctgaatgacgcctaggccgatgccaatcagaaccagtcggcgaatccatttggttttcaatgctcgaacactcgcctgcttatgtttagcatcttcggcaagattctgtttcaaatggtcaatctctgctggcacttcagcagcagatcgcaacacttccaaacttgaacgtgctgctgccggccgtcctttcatcattaaccaacgaggagattccggaacaaaataagtcccgatacctaagataattgccggaatgactgccaatacaatcatccagcgccagataccaggaacgttaccaaaagtggttcctaaaaaggcattgagaacaaaagcaagtaactggccagtcacgaccatcagctcattttgtgtgactaaccgcccacgatgactcgttggggcaatctctgctaaaaagcttggaaccagcacagagacgccgccaacggctaatccaaggatcagccgtgcgccaatcagccagccagcactcggggaaagtgacgaggctaccgttgccagaaaaaataagcccgctaacatggtgatgagccgcctgcgcccatagcgatcacttaaacgaccgactaagatagcaccaaaagcagcacccagcgtcaagctactggtgacccaaccctgtgatccaggggcaagtttcagttccgaagaaataaaaggcaatgcgccattgatcaccccagtgtcatagccaaaaagcaggccacccatcgttgaaatcaatgctactagccgcaaccgtgtcttcgcactcgcaaggtgaccggtaaatcgatgattgtgtgtttttgattgatacatgcaattccccctacaagtccaaatgaaccaccgctcacagtgccataccatgaatcagtaactcaatttttagtttacataataaccttaacacttttctgaaaagtctgcagtcagtcactgttcagatgccgacaaatagtcgcgcaatcacctttttgcatggcaaagataaagtcccattttcgagcgggtttcagaaaaatcaatgctagcgagcccgatcaaaatcaaattttggtcaaaaaaagaagccgtcaacttattcagtcaatagcctctttctgataatgaaagtttatttctgaccagttgttttcttaaccagatcagcgttttcatcattagtgatattttggttcaaagcaatttcgtccatcttagccatatcagctgtcgaaagcttcttcatcaagctgcgtactttaaggacagaagttgcggacattgagtattcgtcaagacccataccaagcaacagtggtaccatgattggatcaccagcagcttcgccacacataccggcccacttgccttccttatgtgccgaatcaatcacgtgcttgattaggcgaaggatggatgggttgtatggctgatacaggtaggaaacatgctcgttcccacgatcagcggccatagagtactggatcaagtcatttgtaccaatggagaagaagtcaacatacttagcaaactgatcagccaaaactgcagctgcaggaatttcgatcataatgccaagttggatatcatcagatactttgacgccatccttgactaacttatctttttcttcagtgaaaatctgctttgcttgcttgaattcagcaatggtagcaatcatagggaacatgatccgcagattgccaaaggcggatgcacgcaacaaggcgcgcaactgtgtccggaagatatcttggcgatcaagactgatccgaatcgcacgataacccaagaatgggttctgttcttcaggaagcggcaaatatggcagatgtttatccccaccaatatccatcgtccgaacaacaacaggcttcggactcatcgtttcgacaaccttcttgtaggcctcgaattgatcgtcttcggtcggtaattcagcagaatccatgtacaagaactctgtccgatacaaaccgataccttcagcaccgtttgccagcacaccatcaagatcctttggcgtgccaatgttggcagcaacatcaaagtgtttgccatcagctgtgattgatttggccgtcttcaaaagagcccattcagctttttgcttagcaaatgcttcagcatcctgcttgaacttagctacttcatcatcggtcggatcaacaacaacttcaccagttaagccatcaacggaaataagatcaccgttattagccttcttggtaatgtcatctgtcccaacaacagccggaatttccaacgaacgtgccataatcgcactgtgcgcagtccgaccgccaatatccgtgacaaatgctttgacatacttcttattcaattgtgcggtatccgaaggggtcaggtcatgcgcaaccacaacgacttcttcatcaattaatgctggatttggcaaattgcgaccgagcaagtgtgccatgatccgctttgtcacgtcgcggacatcagccgcacgttcctgcatatatggattgtcggtcataccttcgaatgtcttaataaagaattcggagacttctttcaaagcctgctcagcattgactttttcatccttgatcttagtctctacctgaccagtaaagtcaggatcagccaaaatcatcatgtgcgcatcaaaaacctgagcctcttcttcgccaagcgattcagcggcctttgctcgaataacctttaactcatcattactttgatcaagtgactgcttcaggcgatcgatttcctttgaaggatcatcaaccgtctttttttggaatgacaaatcaggttgaaccagtaaataggccttcgctgtggcgatcccatcactagcagcgattcccttcaaatgttcagccattattcagccaagccttcctttttcattgtgtctgtaatagcagcgatagcatcagcctcgtctgcaccttcagcagaaatggtaacatcggcaccttggccaacacccaaactcatgacgcccatgatagacttcaagttaacgctcttacccttgtattccaagttgatatctgagttgaacttgcttgctgcctgtaccaacaaggttgccggacgtgcgtggatcccggtttctgcaataatattaaattcgcgtttttccatgactgatctgctccttcgtattaactagatttctagtttttttccgaatagtttgtgtgcgcattcgtacccaaaacaattcatgtaaaccttaccattttttgaagcttgtcacaagcgccacatcagatttggcgcctatattaacgagaatcaactgatcgataatggtattcaatgacaccatcacgtttagccattcccacgatctcttcacgatcaggataattcgtccatgccgcgcgaaacgccatgaacgtttctggcgtcaccgtgattttgtcccgctgaccagtctttaactcatctattaaagcgacgtaatcctgagtcatctatttgcctcacctcacctaataagagtagcataaaagctggtaaggaaaaagcgcaagtgcttgctgtcactgaaatttttgcaactttttagcactcttagtggcagagtgcttgcattccagaaatgtgggtgtatactattgccataggtcaagaaaggtcaaaccttttttgactgcacgtggcacctaaacagataggaaggttgtgacaaaatgctgtgtgaaaactgtcataagaatccagccactattcatctttcaaccgttgttaatggcactcgacaggaaattaatctctgccaaaactgttatcaattactcaagaaccaagcaggaggaaatatgagaccaactgatgcaaccgatccatttggtttcggcagcttagatgatattttccgtgcgatgaatcagggaatggatcaaccgcaacaaccaaatgctcagaccccgccaactcaggcaggccgtggcggcaatggtaataacggccgcaatggcaaccgtggcaagggactgctgggacaattcggcgttgatctgactgaacaagcacggaatggtcaaattgatccggtcattggtcgtgacaaagaaatttcacgggtgatcgagatcttaaaccgccgaacaaaaaataatccagtcctgattggtgaagccggtgtcggcaagactgctgttgttgagggcttggcattgaagatcgctaatggcgatgttccgtcaaaacttcaagatcggcacgtcatccgactcgatgtcgtttcactagttcaaggaactggcattcgcggtcaattcgaacaacgtatgcaacaattgattgacgaacttaaaaagaataagaacattatcttatttattgatgaaatccatgaaatcgtcggcgctggcaatgctgaaggcggtatggatgccggcaatgttctgaaaccagcattagcacgtggcgagttgcagctcgttggtgccactactagcaatgaatatcgtcaaattgaaaaagactcagcccttgctcgtcgtctgcaaccagtcctcgttgaggagccaactgtcgaagagacgattaagattctaaaaggcctgcagccgcggtatcaagattttcatcatgttaaatatacagatgccgccattgaagcagctgcaactttgagcaatcgttacattcaagatcgtttcttgcctgacaaagcgattgaccttctggatgaatcaggttcccggaagaatctgaccattgccactgtcgatccagaaacgatcaagaccaagattgacgacgccgagaagcaaaagcaagctgctctgaagcaggaggattacgaaaaagctgccttctatcgtgaccaagttactaagttagaagatatggctaagaaacagtctaatctgcctgaaaatgaaattccgactgtcaccgaaaaagatatggaacagattgttgaagaaaaaaccaacattccagttggtgaactgaaggcgcaggagcaagcacagctgaagaatctggctggtgaccttgaaaagcatgtcattggtcagaatgaagcagttgataaagttgctcgcgctatccgtcgtaaccggatcggctttaacaagtccggtcggccgattgggtccttcctattcgttggcccaacaggtgtcggcaaaactgaactggctaaacagcttgccaaagagctgtttggttctgaagacgccatgatccggtttgatatgtcggagtacatggagaaattcagtgtctccaagcttatcgggtcaccgccaggctatgtcgggtatgaggaagccggtcaattaactgaaaaagttcgccgaaatccttatagcctcatcttgttagatgaaattgaaaaagcccatccagatgtgatgaatatgttcttgcagatcttggatgacggccgattgactgattctcaaggccgtaccgtttccttcaaggacacgatcattatcatgacatccaatgctggctcaaccgatgccgaagcaaacgttggttttggcgcagctttaagcggtaagacgcacagtgtgctggatcagcttggtaattacttcaagcctgaattcctgaaccgatttgatgacatcgttgaattcaagtcattgtctaaagacgacttgttgaagattgtgtcactgatgattcaagataccaacaataacatcaaggatcagggcttgacgattcatgttaccgatccggttaaggaaaagctggttaatctcggttacaatcctgccatgggagctcggccgctgcgtcgagtcattcaggaacagattgaagaccgcgttgctgacttctaccttgaccatccaaaggctaaggaacttgaagcccgcatcagtaatggtgagattacggttggtgaacctgccaaggctgaaaccactcaaaaagctaaaaagtaatttgttttaagaaagccctcgaacttcattgcgttcgagggctttcaattcacatattattattttccgttaaactgttttataataaaaacagtagggagagaaatggagggcatgagcatgcgactgattaacgtgaccaacagtttcagaaatctagtaagccaacaattgagtggtaccgatgcccggctggtcaaggtcttctcacttggccaaacgacagttgtttatacggaggcaccttcccatatcgaacttcttttcaccaatgagcgccgcaatattcagcgtgcggaaattgctttcacactcgaacgacttttgcaaaaggacattggcgatgtttcgccgattatgggtcatcatctggcagaagtgactgttcccaagcttgagcggcaagcagagtaacccgaagaaggatagtgccatgcttgccaatatcaatgagatttttgcacatggctagattaataagcgcacacaaaaagcggctgacattgctcagccgctttttgtgtgccacgatactcatacccaaacaccctattacattttggcagttaatttaacgtcaggatacttgtctgcaaaccagcgttcagcgtattgattctcaaataggaacaacgggtcgccgtggatatcctgaaccaataagttccgggaactgctcatcttttcatccaattgatctggattgatccagcgagccgttcgcgagccaatcggggtcataatcacttctgaatgatattcatgcagcatccggaattggaaaacttcaaattgaagttgcccgactgctcctagaatataatcattcgtgttataggtcttgtaaagctggactgccccttcctggacaagctgctgcatccccttatgaaatgatttttgcttcatcacattcttcggcgtaacgcgaacaaataattcaggggtgaactgcggtaatttttcaaattgaatcggttccttgccttgataaatggtatcgccaatttgaaaattaccggtatcatacaacccaacaatatcaccggcaaccgcagttgaaaccgtttcacgggtgtcagccataaattcggttgagttattcagtcgcatcgttttgccggttcgatgaaggatgacatccatcccccgttcaaattcacctgaaacaattcggacaaaagcgatgcgatcgcgatgagcagggttcatgtttgcctgaatcttaaagacaaatgcggaaaactctgggttagtcggattcacttccccgccttgttctgttttcttcggtcccggttcgggtgcatattgaacgaagctattcaaaaatgtctcaacgccaaagttagtcaacgccgacccgaagaacactggtgtttgctcaccagccatgatctttttcaaattaaactggttacccgcgtcattcaataattcgatatcatctaatgtttgcgtataaatcgaatcctgcgtcaatggttgacttggatcaagctgaccttgatcattcaacggcaaaaatcgatcatcaccttcacgccgataaagctcgattcgctgattcactcgatcgtagagacccttgagtcccttacccataccaatcggccaattcatcgcatagccttcgatacccagcaagtcttcaagttcagcaatcaaatccaatggttcgcgaccatcacgatccaacttattcatgaatgtaaaaatcgggataccacgttgtttgacaactttgaacagtttcttggtctgagcttcaatcccctttgccgagtcgatgaccatgactgcggcatcaaccgccatcaaggtccgataggtatcttcagaaaaatcttcatgcccaggggtatccagaatattaatgcgtttgccctgataattgaattgcatcacagagctggtaaccgaaataccacgtttcttttcgatttccatccagtccgatttcgcaaaatgtccggattttcggcctttaactgttccagcctcgcggatcacgccgccaaacaataaaagctgttccgtaatcgttgttttcccagcatctggatgtgaaataatcgcaaatgtgcggcgttttgcgacttcttttgctagttcctgtggtttcatcgtgctttccttccaaaattgacaaaatttgctatcaacgttgcctacttacgcagacagcatcgctagctatcggcctcgtgggaggcttcttctggtactggttccgatgatagatgaatatgaacattgacgagtcgtgacccctcaactttgccagtcgccaacaacacacctggtgccagctgcattttttcgctgtgatgcgatgaaggaatggcaccaagttgcgtcagaacataacccgcaatcgtgtcaacatccggtgcatccaaatcagttttaaacaaatcattgaagtccgaaatcggcatccgccctgagacaacgaaatcatggtccccttgtttcgtgaacaatttttcaacctgatccgattcgtcatcaatttcaccgacgatttcctcaagcaagtcttcaatggtcacgatgccgacaacgccaccatattcatccaataagatcgccatttgttgttgcttcacttgcatttcagtcaacaaatcatcgactgtaatggtttcgggaacaaaaaccggcgcggtcatgaccgattcgattttaacatgatcaaagccgacgcggcgtgcttcctttagcagattcttgatgtgaacaatgccaaccacgtgatctttgtcttcttcataaaccggaattcgtgaatagatattgttcaaaatcgcgtcaatcgccgtgtgatcaggttcttgcgcatcaaccataaaagcatccgttcgcggcaccatgacctcgcgcgccatcgtatcggacaacgatataattccctcaaacatttgatactcatcgggatcaatcgccccagaatttcgaccactttcgatcatggaaaccatttcgtcacgggtcacggtttccccttcatgattgaattccatcggcgtcagtttcattaacaacttggttgaagcagaaagcagccaaacaaacggacgcatcactttggctagccaactgatcggggtcacactcattttagcaacccgctctgtcatttgtaacgctacctgtttgggatataattcgccaaaaaccaacgaaaaataagacaagatcagcgtgactaagatgaccgctgcctcatgcgcaaatgaccagccgccaaaaattggtgcaacccgatctgccagcgttgttgcggccgaagcagacgcaaagaaaccggcaaaagtgatcccgacttggattgttgccagaaaattactcgaatccttcatgatggtcacaagcttggcggccttacgatcgcctttatccgcctgcgccttcatacgagtacgggaacttgaaaccacggcaatctccgccgcggcaaatcctgcattgattaaggtcaaaatcacaatgaggatcaattgtccccatatctgaccgtctgggtcactgcccatgcaaaaacacaacctttcgtaaaaaaaacggggaatcatccccgcttcgttcgattatttcagtataccaagtctttatttatttttcaattgtggatcggcttgatccttgatctgatgagcttctccagcattttcctcatcactgtcagcatcctcgtcatgcttatgttcctgatggaaacgataaagctcgtataagtatgtcacaactgttttgatgacagcatatgtcggtacagctagaatggtgcctaacaatccccatagattgcctgcaaccatcagcaaaataatgatggttaaaggatgaatgtccagtgagcggccgatcacattcggataaataaaattaccatctgtcatctggataatgacgacaacgacgacaacgagtagcatctttgtccatccctcagtggcagcaattgccaaagctggtgcaataccaatatagggtcccaaatacggaataatggtaacgatccccgcaataaagcctaagagatacgcatacggcatgccaataatcagataaccaataaaagtaaaagtgccaacgaataaacattcaatggcctgcccgccaatatagtgagacagtgtcgagtttaaacgcgtaaaaacagttgcaacctcttcgtgataccgatgaggcaacatcttttgaatacttggcacaaagttttcaccgtctttgagaaagtaaaatagcatcaccgggattgtaatgatactgatcatcatgctggctactgatccgataaccgttggcaagccggtggaaaaaccgcccagaactttgctcaacaccttgcttggcgaaatttgaagactggcaacatatttgccaatatttagccgctgataccaagtatagtgtgacgccttactaatgaatgaccggacgccttttaagaaatccggaatattcgtaacaaactgagtgacctgatagatcaagtttggcagtacggccatgaataccagaaccaaggcaccgatgaccaccaagaaaatcaataaaatcgaaatattgcgactgatgtggaacttctgcaataatttaacaatcggattgaagagatagaacaaaaaaccagcagataaaatcggaatgagtagcgttgagaaaaaagtcgccacaggtgcaaacaagaatgaaacctgtgtcaacccgatgaccacaaaaatcaaaatcagaatttcaacggaccaaaacattaattttgaatgccgtaacctatcaaacatattcgacctccccagcagcattttactagtgctataatagcaaacaatttattaaaacggaaagaaggttcaacttttggaagtcaaaacgacaacaaccctcgattcacagattcatcaagacagcgtccagattcgcacccacgttttcgtggaagagcaacatgtgccaccagagctcgaagtcgacgccgatgaagcaaaggcgacctattttgtcatttacgatgcaggtgtgcctgttgctacggcgcgcattctgcctgagggcgacgcctaccacgttcagcgcgttgcagtcgaaaaagcctatcgcaagcacggccttggtaagatggtgtttgaagcaatcatgacttatgcccgcgccgagcaaattcaagcgctacgcttaggtgcgcaagttcaggcgattggcttttacaaagccctcggttttcaattgaccgatcgccctgaatttcttgatgccggcatccgccaccgtgaaatgatactcaagctggcttgataatcattcaaatttatcagcttcacttgattaaaccatgagtatgtgagaaaaatgcgatcccaacacgaagatattgggatcgcatcaattcaacaagcaggctaatcccctgcttgtttttgtttttcatgcatcttactcatactcatccacaccttttaactgatgaggatcaatatatagacgataagccacttgatgaaccgcgccattttgaatcagatagctttcaagataataaggatgatctgtttgcccgagtctttctggcaaaggataccctgccttttcaatgagttgcagacccttattaaagcttgttgcaagtggtaattgtttcaacagcacacttgtagctggctgcctgacctgaccagccgttgcttcaggtaggcgaaacgcttcataaggtttgggaaccgctgcatcagccggtaacaagctgccgatccaatataaaaaggtgtcatatggcgaaaagacaaccatcgccgatcgattgggtatctcggctaaatcatcgagcgttttaaacccaagttgcgcttcaaagtcttgccacgctggttgaaatgtaccaagctgatcactgctttcgacggtataggcatgacccgcaaaaagttgagcaggttgttttggaatttgtttcatttttgcctccaagtttgaccggttgggctagatccggtgcgctaactgaatgtaacgacggtaccataaatcgacataggcttgtgaaaagggtcctttgccgtggttgatccaatcgacaagcaccttcacattagcttttaaaatccgatcagtggttgcaggatactgccaaagtttacgatgggcctcgtattcatccacatccagcagccgtttttcaccatcggcaaacaccttgacgtctaagtcatagtcaatatattttaaagcttcttgatccattgtgtacggagtggccagattgcagtaatacgacacgccgccttcacggatcatcgcaatcacattgaaccagtaatgcttatgaaagaaaatgatcgccggttcccgcgtcagccaacggcgtccgtccgactccgtcaccaaggtgtgatcattgcacccgatcagagcatcttcactggttttcaagaccatcgtgtcacgccaggtgcgatgcagactaccgtcatgtttataactttgaatagcaaacgagtcgccttctttagggatccgcatacaaaacccgctttcttggaaatttcgttctttattatagcagagcatggacaggcgcgcttagaaactagcaagcgtgtgaagcaacccgataaaaatccggtgtataagccaacctcatgtgtgatggccagactttgttcatttgtgcctgaggttgacttattgcagcagtgaacgcttttcagcaagagtcggtagcttacaagggcatgcaaaaggatagcttgatctttcaaaaaaatacgatcaactttccgccaagtcgtctagcacttcatcaatagcttccacatcaaagcctttacgaaacaaagttgttttaactttttgtttgcgctctcgatcatcatatttcgcttttagacgccattgtttggctgcctcaagcttaagcaagtcgctttctgcctcaggatcgggttgcgggtcgatggttgcgatagctgtttggatagtagtgtcatcgaatcccttttgcattaaagcgactctgagacgttgcagttggtctttataagcgcgatgctggtggtgccgaagattcttctgacctgcgcgaacagccgcatctagccatgctgttgttggaatagcagctaactcattggccaacaagtctggcttgaggcctttttgttgtagcttatgttgcagcgttcgcggcccaagttcacccattttcagatgctcttcaatgtaacgatgcgcataatctgcatcatccaaaaagcccagatcggtcagacgcgtcagcaccttttgaatcacatcagccggtaagtcttctttagctagccgatcactgacctctttgctcgtgcgactttggtggctaatgtaggtcagcccgatctctagtcccatagcggtgacttcactgctcttgatttgggcaatggtctctgctgtcaataccattcctttggccaagcggtaatccaccagcgtggtttcactcaccggaaatgcgtaagtcccgtcaataaaaatattatagcgcccacgccttttttgggcggttatctttgtaatttcactcatgaacccctgtcacctctctaatcacgttgccattctatgttatactttttataaataaatttggaggctcgttatgtttgaagccagtttctttgaccggcacagcttaattaattatcaactattccgggcaatgaagaccctacaacagacgacaatgtcgatcaatacgcttagccgcaatactgggctttcgtattcgcagacttatacggcatttcagaccgttttagcacagctcaaccaaatcttacctgacaaaaagattgacgaatcaaacttcgcagcagttttgcctgatgtttcgattgatcgttatcggttctcgctattaaaaaacagtctaccatttgaatttttcgatggggttttcaagaatccgcattcggactttcacgccttcaagcagcaccatcaaacaagtatttcaacgttgcggcgccgaatttcgccgtttcgagactacttagctgacaatggtgtcacgctaaatagtactacttgggccattgaaggagatgaattgcatatacgcttagccatgttcaccttctttacattagcctatcgcggggcaggatggccattttcaactgcagaagagcgggaagcaaaagcacttctcaaggtaatcaaccaaacaaaacaggctttcttggtgtcaccaatgcaaccaatgtccaaagaagctttactaattctcgccattcagatgttacgaatcaactgtgggcacgcccttttaccaaatcggcgaatgcagctgttgtttgacggtgaaactgaattgccagatttgatttttacgccagactactttcccaatttatctgcttctgaattaaaagcagaaaaacagtattactatttttcgcgtatgtattttatgaccgtcactcggcaaccacatcaaattgattatcagatcatgacccattttcaaagtaaagataacttagtgaatcgatttgtgcgacatctggtcacttctttgaataaccaattaaaagaaaccaaaagtcagttaattgccgaaaatcaagtcatgatagccaatctttaccgattaagtttcaccgagtatgtgctgaatggtcattttagtcagaggcttgattttgcttcgacattgcatgacgaagcacgaacaagccaattgacggccaaaattcgcgactgtttgaaacgaattcccaaaatggcgcctgagtcaatctacgcagactttacaagccaatttattaatggtctctatatattagtcaatgataattatcctgaactcaatcgtgacatgcaaatggtcgttaacgttttgattgaacatgattctttcgtcaaacgggatctcttaaactttttaaacgatttaggctttattcgcgttgtgcctccaaccgaggcgatcaatcctgatttgatcattacaacgctgacaaagccaaaacgggtgatcccttgcatgggccacccgtttgatccaactgttcccttgatcacttggtccaaggaacccagcgatcaagactattttcacctttttcaacgcttaaaacgcctacagcgcgagcaacgaacagcagccgatacgaatcagactcgtcagtgaatcggttttgccgtgtagccgacaaagtagactagggcttcatacccggcaagtcccaaaatgaccgctgcaattagaatcgtttgactgaagttgcgattaaaccaaagaaagactaccatcgcaaacatcacaacaaaataggcattttgtaggctgcgattgatttgaatttcaaattgggcatccggactttgatagtcaatcgtgtggatcgcattaaaccgaccaactttataagtaatcttatcgccgcgttgcacctttaagtctagcgtctcgccaactcgtatcgtatgcggcgtgtcattttgccacaccgttgctgtcatttttctactcatcgtattcgaataattgattttcacattaaatcctcccgatgattcattatactaaacattcttaagcctcgtcaccatttctcaaagcaaaggagcatttcatggcagtcactgtcaaaatcggtcagcgttttcccctgaccatcaagcgtctagacattaatggcgcaggtatcggttattatcaacggaaaattacgtttgttaccggtgcactacctcaagaggtcgtcgtcgcagaggttactgggattcacgaccgttatcttgaggccaaagttcataaaattcggacggcgtcaccaaatcgcgtaaccccggcagaaccgctatttggacaaatcggcggggtcgaactcaatcatctcgcttatccggcgcaattgcgatttaagcgagatgtcgtcgcacaatcgcttgccaaatttaaaccgactggctggactcattatgatttgcggccgacgattggcatggcacaaccaacgcactatcgaaacaaggcccaatttcctgttcgggtcattgatggtcacgtacgcgcaggtctttatgctccaaactcacatcatctcatccctttaaccaagtttctgacccaagcaccgctgacaatgaaagtcgtgacaaccttgtgtcagattctcgaacagcttcagatcccgatctataacgagaaaaagcgctccggaattgtcaaaacattggttgttcgcgaatcatttgcaacgaaagaagtccaggtcacgttcatcacgaacagtccaaaattaccgcacgaaggcgaattgctcaatgccatcgccactcagcttcctatggtggtcagcatcgcccagaatatcaatcctggcgaaacatccttaatttggggcaaagaaagtcgcctgctggcaggtctcccgtatatccaagaaacactgttaggccggacttttcaactctcaccacaagcatttctccaactgaacccaaaacaaacagagacactttatacattggccgcaaaagcacttgatttagggccgcacgacaccttaattgatgcgtactgtgggatcggaacagtcggcatcagtttagcaaaaggcaatcaacctatttacggaatggacaccattgcggaaggcattgccgatgccaaggcaaatgctaaagcaaatggcctcaccaatgcccattattcagtgggcaaggctgaagacatttttccaaaatgggttcaggaaggcatgaaaccagacgcggtcatcgttgacccgccacgagctggactagagcgtgccttcatcgacgccctccttgaactcgatccacccaaatttgtctacatttcctgcaacccttccaccttggcccgtgatctcgttttcctcactaaacgctacaaagtcgactggattcaaagcatcgacatgtttccacaaacagcacgatgcgaagcagtggtaaaatttacaagagcgtgaacagccgcgtttagaagccgaaccataagcggccgtttaggttcaaggtctgtatgtgtcagattttgcgactatgaacgcgtttcatcaggccatcacttcacggcaccccacccaaaccaacaatcccgcaaactacagacgaggtcttaaaaaatgaaaatttactttgctaacgccttgttcagtcatgctgattttaattacaatgcgcaactcgctgcccaaattcgccgcgccttaccagatgttgacatgtacgtgcctcaagaaaatgccgcgatcaacaacaaagaggcatacgccgattcgaaaatgattgccgaagccgacaccaagcggctgctgtcagctgacttgatgattgccattctcgatggccccgtgattgataacggggtcgctagtgaaatcggcgttgcctatgctgctaagattcctattttgggtctttacacggacagtcgacggttaggcgccgccaatcaacaaaaactcggtgctttgcaacaagttgcagaaaaccagtttcactatctcaatctgtataccactggtttaattaaacttaacggcgccattttaactgatgaggatagcttgatcgccagtatcaaatcccgtgcttaaatccgattctagtgacatgtaaaaaagcttgctaatatgttagcaggcttttttacatgtcactatcagccgaattaagaaaattaatgcattttcttaagcataaaaaatttggttttacgaaagtcataaaagattttcgaaaacgcaaataattttccagaacttagatacgaatcgtcacgaacaactaaacttggacttccgtctgcaatcccaaagaatttggctggtaagccagaaatcatttcacactcaattacagagtcaatgaatccaactttcagaccaggcttttgatcaataaaagcaaatagggacccctttaatgcactattcggaatgttgtccacaatcgatcttaaataatacgagtgttctactaagaacggttgaccgtctagtgttcgttgccgcgtcaccgaaattaatgtcgtctcattcggcaatttctggctttcaggcaaaaaatctgcctgatctagcgtaatgacttgttgatgaattgccgttgttttaacaactcgtccctgtctcgccatttcttccgtcaacccaacgttattttgaagcgatatggccccctcaacgtggtgtgggcgagcaaaagtgccgctaccatgtgcctgataaatgtagcccaaattggcaagatcttttaaggcttgtcgtaacgtgtaacgagtgacttgatattgacgcatcaattccggctcagcaggtagttgaccatcttcatcttgaatagcaccttgttgaatcgccttgattaattgattctcgagtgttttaatatcatagctactttcccgctgagacaatttatttccgcctttcaactttgcttccaagctcagtcatttcatgttattataccgccatttactgttccggactagctccacgtctccagtaaaaaaaacgcccttcgaaaggcgtttttttgactacatgcattttcatgctaggcgagatcatccccgttactacgaatcactttttgaaaccaatcaaaagaggcttttttgcttcgtgcaagtgtgcctttaccttgatcatctttatcaacataaatcacgccataacgtttttccatttgaccggttcccgccgaaaccaaatcaataatgccccacggtgtataacccatcagcttgacaccatcgacctcaaccgcaagtcgcatctgattaatatgttgacgtaaataatcgattcgatagtcgtcttgaatatggccatcctgattgatcttatcaaatgccccaaaaccgttttcgacaataaataagggtacctcatatcgatcactaaaccagttgagtgcataacgcaacccgactggatcaatctcccaaccccagtctgaacgttgaagcgtcgaattcttaacctctcgattgtgtcccatggtaataaagtctgtaggttcatcttgtgaggcttcagtgacatgggaagcatagtaagaaaatccaatataatcgactttcccagctaataaaacatcacgatcttcaagtgtgatgtccaagttaaacgcatgtcgatcaaaataacgatccaaaaatgcaggatacttgccctttacttggacatctgccagataataattagtctgcatcgttcgctcagctttaaacacatcatttggattcggtgttgcgggataaacaggacccatcgcaaccatacagccaatttgaaaatcggggttaatccgatgcccaatttggactgccaaggcacttgcaacggcctcataatgagcggcttgaaacatgactgcttctttatcttcatcaggcttgatcagtagcccagaattggtgaacagagaccattcattcatcatgccaacctgattattgatttcgttaaaagtcatccaatatttaactttgtctttgtaccgatcaaacacaacagtcgcaaatttgacgaagaaatcaatcaccttacgactacgccaaccaccatattttttgacaaggtgataaggcatttcaaaatgtgacaaggtaatcactggttcaatctgatgcgataaaagatcatcaaacacgtcatcataaaatttcagccctgcttcgttcggctgttcttcatcaccattcgggaaaattctagtccaagctatgcttgtccgaaaacagttcaagcctaaatcagcaaagagctgatcatcttcatgatagcgatgataataatcaatagcatcatgattgggataattctcgcctgattgaacaccgtctgtaattctgcgtttagtttcattatcgcctgcggtcatcacatcagcaatgctgacccctttaccgcctgcttgccacccaccttcgaattgatgagcagcgactgcgccgccccacaagaaacctttaggaaatgctgtcaaaataatcctccttatttagtcctcgaaccatttacaattggtctgccgcttcttaagccgccgcctccgctgcaccttttgcctgctcatctttatatagtttgccatcatagaacttaataaatgggaaccaaatcaggaaggctacaagcgcacaaacgaaagctaaaacaattgctcgccaatcgcctgccgtgccgatgaaccctgaaagaccaagtggtgttggccatgccggctgtgcaatcatcggtttaacccaatgcattgaaattgcgaagtaagccatactcatggatgccatcggtgctaagaagaatggaatcgctgtatatggattataaacaactggcataccgaaaagaattggttcgttaatgttgaagaaagctggaacaacagatgccttgcctaatgcaccaagctgtgccgattttgcaaagaaggcgataaaaataaccattccaagcgtagcgcctgatccacctatagtcacaaaacagttattaaattctccggcaaatgggatgtttgcccccttctgattcaactgcatattggagagaacaattggggtaaggaacgaggtcacaatcgttgcgccgtgaatgccaacgatccaaagcgcatgcatgataaagtagacgaccattagtcctacccatgtactggtcaggttagtaacaaaaccaaacggaatagcaacaatcttatagatatcggtgttgaatgccatcaaaataccattaatgataatgacagttaaggcaatcgcagcggtcggaatcaaagctgtaaaggaacgtgaaacaccagccgggacggtatccggcatactgaccacaatattctttttaacaaaccacgcataaagttttactgcaataatcgacatgataatggccgtaaagataccagtcgttcccagccgagttaccccacctgcgatggcataaccatctataatcttgttgtccttggtgatttcggtgaccaaggtcgctgtcccacctttaaagactaattcaggtatacacataaaaaacgccatcatagaaagcaatgcaccatttaaaggattaatatcaattttttcttcctgagcctgaatgcgagtatattcataaccaaaaactaaacagaaataaagtgctaaaatgcccatggtcgcgccattagcaagcatatacaaatttgcaaccttatcaaaagaacccttccaaataccgactaatgccggaaaactttgggggagaacattaataattaaaaacattgatccaacgatggtaaatggaatggatgccattccggcagccatgactccgcgaacgattctgaacgaggcaagttttcccattggtcccatcaaatgattgttcataaatttaaacaatttattattacttgaatccatagttttgtctccttgtttgagctcattgtatgctttgagcaaatttatttatttgttgtaaataccgatcctgatttttttcaatcaaacggatacgcactaagagataaaaacatatgcctagaccaattaacagaacagtcgttgccagagataaacccttttgtcctaaaaatggaaacagttttgtcccagatccagcgacaattatggataagctcaggaaattgcttattaactgaactacataaccgaacttagtaaatggtaacttgctatctcttcgccagtacttacttacttgttcaaccgctaccactgcatttataacggtcaaacaaaacggtacccatttcatcgcgccctgtgtgcccaaactaagaaaaaaccaatataaatttgcaaagaaaaaaccggcggtcacgtaacggattaataaatagcgattaaagtacatactagttaagcttaattctctccgactcttgtcatatcttgctttattttggtctgacatgcgtgtcacattcctttcgcttagacttatttcgtagctaactttttatagaggtcaacgatttcccctgctaagtctcgaaatgtgattgcattcataacatgatcctgtccgtgcaccatcaataatgatactggatgttttttcccttgagcttcttcggttaacatacctgtttgtgcattatgtgcatctgacagaaagctgtctgcctctttcagttttgcttctgcggtagaaaaatcaccgacttttgcagctttaattgcctcaaaagaagatccttttgcatttcctccggccataattagctgcatgatcactagttgctcttgctcgttcatcctgacctcctactgctcgtcaatcagcttaagagccgtttttagaacattttcgcctttcattaagccgtaatcctgcatattgatcacttgaactgggatactaagatcctttttgaaatctccctctaaataacgcacttgtggtccaagcatcaggacatctggtttttctgaatctaacttgtcatgggcatctgaagccgaagtagcaaagatttttgcttcaataccatctttggtcgctgcatcttccatttttttgactaacatactggttgacatacctgctgcacaaactaacataattgtcttcttacccattagtttttcctcgctttcaaaatttcaaagttattgttcaccacagaatgactttttaatatcagcatactcgctagcttaacgagccatatcagaagtcattcgaatgactattcgttcgaacgacttttataataccaagaaatcgctttcttgtaaacgatttctttaattttttaaaattttgtctctacgccttatcgcaaaagcccggcaactaataatgaagacttaaaatagcggtaagcaaaaaaaaagccttccagcaaggcatattaattgctggaaagctttgtaatttatattttaagtcaaccagttaagcatttgttaccggtttctccgcatcttccagtaactgtcggaatggaatcagactttctgcatgatatttcttcacaaaagcatccacagcagcaggatcctgagtttgcttgtccaaaacaagttgttcaaccggaattggccgaagatcagaaatcttcacatcaatgacaaccggacccttacgatcttttgccttagcaaatgcggctttcaattcgtccagattgtgcacttcaaatccttgagcacctaacgcttcagttgccttaccataatcagcatcaattaaatcaaccccggagtgcggctgttgcgtgtcatcctgttcagcttcaataaagcctaaactctcattcgtcaaaacaacgttgatgattggcatatgatatttgacctgtgtcagaatatcctgcatgaccatggcaaatccaccatcaccagaaattgaccaaacttgccgatcagggaattccgcttgcgcaccaatcgctgctggcaaggcataacccattgtcgcataccagccagacgtcgtgaacacttgatcatcattggtcttcagataacgcatcccattgatggtaacattgccaacgtctacttggaaaatggcatctttttcggccatctcattgatcaatttgaagattggttcaacgcgcagtggcgtggagccatcatcttcaaatgaagtcatccactcgcgccaattttccttgttggccagagcagcccgataccaagcgctttctggcaattgatcagccttttcgctcagtgccttgatgaacttcttagcatcggccaaaacagctaagtcaaccgtgtgacgacggccaaacttgctaccgtcaatatcaacctgaatgtatttagcatttggtgctataaagtatggctggaatgggaaatccgatcccaagaacaagacggtgtcagcaccgcgcgcaacttcaacgccaggtttagaagccacacggccggccgagcccatgtttgccttataatcatcaggcacgattcccttagccaaggcagtcgtgatgatcggaatatgcgttttttctgagaaagcgatgatctcgtcgcgcgcaccccgcgcgccatttccaacatacaagattggcttcttcgcatctttcaagatatcccaagctgcggcaacctgatccgggtctgggtcaggcaaaagcggcttctggtacagattggctgatgatacataattgtcatcaatctgggtccaacctaaatcctttggaatagtcacaacggcaaccccgttatgcttataagcctgacgaatcgcctcgtcaacaacatgaggcaattgctcagcagtcatggctgtacggttgtatacagacacatcagcaaacattgggttctcgttcatttcttggaaataattggtgttcatggcagcagttggtacttgccctaccaatgccaaaactggcacattatcatactgtgcgtcatacaacccattcagaagatgaacagcaccaggaccggcagaaccaaacgtcgccccgattcgacccgttaccttagcttcacctgcagcagccaatgcgcctacttcttcatggcgaacctgaacataattaatggtgtgacggcgattgtacagcgcattcatggtactatcaaaagaaccgcccggtaacccataaatattatggataccccagtcttcgagcaccttgatcattgcgtctgcggcgtttattttttctgtcatgacacttgcctccaatattattacttacattttgtaagttctttacgattacgagtataacaatttattgataacaatgcaagccctttcatctggtttaagcaaccttaacgcccaaattgcgaccttagcgtataaaacgcttgaactagcaagcgacgacaccataacagtcaaacaagtgaactaatacagcatcaccacgccataacatgcttggtaaatctttttcacaaattaacttaatgatgatcaggatcatggatcaaaaaaaaggaccgtcgagggacggtccttttcatcatcttattagctgtcaagcattaccgctgctgatattgacgttcttgaccgatcacaccggtcaaaacaaactgaccgtgataataagtcggatcactacgataatcttctggatcataaggcaccttatcgctgaaaacagcttcgtattcaggaacggttaattcctgacgatcagccaacattttagcgtgattggctgcatgcagttgtgcggcaaaatccggttgcaagatgccgctaaaaaattctgccacagccccggagccatacgagaataaaccgatccggtcacccgctttcaagctagtatcattgtccaacaacgacagcagacccaaatacaaagaaccggtataaatattgccaactcgccggcagtaccgagtgcttgcctcaaagcgccgttgcagtcgctcgccagtggcttcatctgtgtccggcagaacaagctttaaagctttcttgcccattttggtatacggtaaatggaatgtcatcgcagcaaaatcacttgctgtgtgatggcgttgggtctggtatcgtgaccaaattgcttgaaaaaaagctaaatattgttccgttgaatactttccttgtgcaattgctgtgtcttgataaaccggccgccaaaaatcggcaatagattcagaccgataaaccgaatcgtcttcaatggtcatgatgtgcggctctgctttgattaacatggcaaccgcgcccgcaccttgtgtgacttctcctgctgttgccaaaccgtaccgggcgatatccgcagcaatgactaaaacggttttatctgggtgagcggcgatgtagtcacgcgccatcattagtgcggcagtaccgccataacaagcttcctttaactcaacggcccgcacccactcagggagtgccaataaatcatgaataaacaatgcagccgatttactggcatcaacaccactttcagtaccaaccaagaccatgcccaagctagcgcgaatcgctggcgtcaacaactttgtcgctgcattcgcacccatcgtgacaatgtcttggctagaaggtggtaccgcttgctcgtcttggccaatgccaatcgtatatttgtccggatcatcacctcgaacctgcgcgagttttactaaatcaacgtagaaatctggggtgtccatagcgattgcatcaatcccgattttcatcttttgattggcctactttcttgtttaaacgaatggttgttaaatattgttgcgcatgttttaaatccatactaccttgacgaagtgcgttcacaagcatcggcaattctgtttctgttgccccggcagcaatggcgagggcattagcttgcaacttcatgtgaccagcttgaatccccggtccagccaatgctcgcatcgcagcaagattttgcaccaacccgagggcggcaataacttgctgcatgatagctaaattctgatacccaccgagccgacggacaacctgcgccattggtaaagcaccgatcgccccgccaactgcccccatcggcaagggcagctgtaagtgaccaactaaatggccctgatccatataccagcgcgataaaggctgatacctgccagacgcacatgcaaatgcaccgatacttgctgcgacagcgcgggtatcattgccagtagccaatacagcaccaataataccgttaagaatgcccttgttgtgggtcactgcccgctcagcatcgacaaaggctaaatcgctaagctgaacaattttcttagcaatcacatctccagaaacagctttcgtcgctaaagaaaccggctcaagcgaaacctcagccgtcacgagttctgttggcgcgttggttagaatactgacaagcacatcaccgtctacccagcttgtcaccgccgctgcgaccgcttcggcaactgtattcgcataattggcccccattgcctgttgcggatcgagcgttaaacggattttcaagaactgcgctcctagtgattcgactgttaactgatcaagaccaccgccacgttgaatcatcgaaggatgcgcaaccgcaatgactttctgaatatcagtctgatgagccaaaatcgtttgccttgcttgcactaagtcggtcaagttagtcaggactacttcagcgaccactcgatgcgccgctacatgggtcctaacgccgccgtttgcagtcgcaagcctggccccattactggcagctgcaatcacagaaggttcctcatccgctataggcacttgatgtagctgtccattgaccaacaaattgcgagcaacgcctaggggtaaaggaaactcgccgatggcattttcgatcagacgcgctcctgtgacttcaggcaagctatgcgtaccagctaacaacgcagcatcctgtgttgttaaccacccttcttgaaccaattgatcacggcgtttttccggagacaactcgtaaaatttcatcacgatctccctcagacatgcatcgcgatttgcatggcgataccgatgccaccgccaacgcacaatgcggcaataccttggcgttgattacgttcagccagatcgtacaataatgagattaaaattcgagcgcctgaagctcccaatggatgccccaacgctaaggcgccaccattgatattgaattgttcatcctttaaaccaaggtcacgagccacagcaacgctttgtgaggcaaatgcttcattcaattcaatttgatcaattgccgcgatagagccgccggttgcctgcagtattttatcgatcgccagttttggcgcataccccataattgccggatcaatacccacctcggcaaaaccagtgatcgtcgctaaataatggagccccagttgttcggctttcgattttgccatcaggatcaaggcggctgcgccatcattaatgccgcttgcgttacctgctgtaacagtaccgccgacttcaaaaacaggcggtaattgggctaatttagccaatgacgtatcgggccgaatggctgaatcacgatctacgatgacatccccgtgacgggcagcaatcgtcactggggcgatctgactcttaaaccgaccctcagctgcggcggccgcggcgcgtaaatgcgaacggagagcaaactcatcttgctcctgacgactgacgttaaattgtgtcgccacattttccgccgtgattcccattggctgctgactgaaggcatcatttaatccatcgcgactcaaaccgtcaaccagcgttgtatcgccaaatttgtggcctgaacgaaccgcttcggcgtaataaggtacttgactcatgctttcggtaccgcccacgagcaccgcgtcagcctcgccgagttgaatggcagcttgcccaagccgcactgccttcaggcctgagccacagacttcattgacagtcatcgccgtgctgctagtggccataccgctttttaatccgatttgtcgggcaacattctgcccagaaccagcctgcatgacattaccaaagatcgcctggttgagtaacgctgggtcaattcgtgcagccttaatcgccgcctgcgctgccgcaacccctaaatcaacggcactggcgccaaccaaatcaccacccaacttaccaatcggcgtccgtttagcacttagaatcacaacttcttccatgatgacctcctaaagagcgtgaacagccaaccggcgcataatcaagaacgagggcaatggccgagccattgttctcgtggttctgatgtgccggtttctgtggctatgaacgcgtttcgacaagcatatgctgagataaaccgtttcagtttatcacagtcgttcagatgacgcactgatataataagagcgtgagccaacccggttacaccgacttttgggttggcgatcgcctaagaacgctactcatctccgttaactaaatagattgtatgcgattgttccccaaagcaacaaccatcttgaccaatccttaatgaatcatttcgaaagaaggctacctcatgcgtgtcaccgatttgctggctttactagccgatcaaaataaaaacgcctcggtgttactcgacacaaagccgacaccaagtcgtttcgacgattttaagttaacaaccgttaatgatcaaccgcaactggtctttcagcctaatcctgagcgcaaagccgcattgcgcgtttgggaattgcaactcttactgaaccaacctgatttacagcaacgattcgtttatctagctgatgttgatgaaccgcgtgcgttatttggatttgttaaacggcaaattggcttgctgctcaattgattacgctggatgtttggtcgcagctaaccgtttagcaacgctttccaaataatgatgactttcaatcatttcccgacaatcaaactgatcctttaaaccaatttcataaatgcgactcgcattttgattcaacagtggcaagacccgcgcccaatcaatccgtccgcggccaagcggtaaactatcatgcgtttgccccatggaatcaacaagatgatagtgccgaatcagtggcttcagatgcgctaggctggccatgagccgatcattatcgccatgtaacacaataaacgtatgactggtatcataggctaaaggtaaatgccagcgcaacaaacggtcttcaaaggtgggatccccatatcggaaaatcggtgacatggaattttcaaacacgacatggcccggtgcttcctgggcaaaagcaatcatgcgcgccaaggcaacgtcttgtgctttgcccacatctgtccagccagcataatcaccaggcgtgtcaacgcggtatccgccgtgaatcaaagccgtggcgttagcttttttggcaaagttcatgagtttaaccgaacttgtcattaaaaagtcatagcgtgtaggatacttcgtcggattcatggcaagctcattgcgctggccgcgaaaccgcatcggatgatgaaaaaccaccgttggcacctgactctgaactaatgctgccatctgtacaaaatgcgaccatccagcttcggtaaaatcattttcggtgagatgaaattcgaatacatcaggatgatattgcagccgatcacgaatctgccgctcatctgtactagcctttaagcctaatagcatgtacacttttcctccttaattcaaaacccgctcatgatcccaaaaattgctcataagaacgttaagcatcgctgaccaaggctctaagcagcttctgctccgatttcgaagcgctcctacttgcactttcaaatttcagttgtctttttaacttggcaaccggcgcattaaacgtttcaattttttacgatcaatcagcatcacacccaagtcgtcggccaaggcgatcgccgaatcagaaaattcgctattggtgatcaccgccgcttcgtcgagctggtaaaaatgatggcccgcccaaacttcctgcacggccttgttgccaacgaaaccggtgtaacgcttgcactgaaagccaatcgttttaccttttttgcgggcaataatatcaattccttgatcacctgaagcctgcgtcagttgaatgtgattaaacccattgcgcttcaacagatacgcgcaaaaagactcaaacttttcaccctccatgatatcgacagtttccattttcaaatcacgaaaacgaaaatgatgatgataaagcatgatggcattgatcacaacaaaaagactgatgatcccaaaactagccggatcaccatattgccgcagttggcggggcagaaaactgcgggcccaaatgctgtaagcgagtgccaaaataaagagcccccacaacagctgataggcttttttgagtaacgttctcatgggtctacccctctctttccctttaagcctagcagattcaccgcgtaattgcattgaatctctgccaatttttctgtacgcttaagggattgagagaggaagcgttttcgtcatgcaactaagtgccaagatctttgccaaagtcggtagtgaacggattacccagtattctttagtcaatgaccatcagatgacgctacgttttttaacgtttggtgctcgggttcaacaggttcgcctgccaaatgctgcaggtgacgatcctaatctgctgctcgggttcgtcacgctggaagactacttacaccaacccggttacctaggcgcctttaccggccctttacaggcagctgacgctgagctagccccgggttcatggcaaaactggaattgggcggttaaaaccagtcaagaaaccgatctagccatcaccttcaccctaacattacctgaaaatgctgacggtcagccaggccagcgagcactcagtattacccaccgattgacaaatgacaatttgtggcagattgacatgcaggtggcaaccactgccgacttgaaaatacatccccggctcaatttgccttggatgctcactgccgaccctgcccaaacaatgctttcagccaagttgactgccgatgaacatgttacccctgtccctaaaactgcccgctgtgagactgtgcaacgctattcccttgcagccgccgattggcagttggcatatctaagcgatgcttcattcacgagaattgattcttacgctggcatcaactccgaaaataattttaacggtattctcggccaacccaatgtagcagtcggcttttcgccggaaatgaaccaagacgctctgccgtgggtgttgccagccggtgcaacttggcggcatcatgcggaatttcacttatctagcaacgcaaactaaaaaggtttgaccccacggtatctgttgtgtggtcaaaccttttttccaatcagtgatgattaatagttcataaaaacatccttgaagactttaacactgtcaaagacgtcttttaaagtgacgtattcatccgtctcatgagacgtttcatttcccgggccataaatagctaaatcaagaccgtcatgatagaacaacgccgcatccgtgatgccggtgcgataggccacttgaccacgattcagccccgcacgttgacgggctgtctgtaccaactgaatcaaatcattatcaggtgaagccgcagctgcccctaaaacggaatcaattgacagactcaaccgaacacccttaggcactgtcgttttagctgcttgtttcaacgccgcaataaacgcatcattatccgcaatcatggttgtccggatgttaccgcgcaaatatgcggactccggaatcgagttgatctgattgccaccatggataatatcaatattatgcgtggcatgaccaagaatggggtcctcttttgcctgcaacggcgctgttgcagttagcgctgcattcgcaaatgcaaacaacccatgaatggcatttgcccctaaatctggccgagacgaatgtgctgctttcccgtgcgcggtcaatgtgtaatcaataataccgcgttcagcagcgtcaacattgctattgccgggttcagccacaagcagtccagttaaacgatctccgtaaccggcagcagacagttggcgtgcgccgtcattatcaacttcttcaccaactgtcgccatcaattgaatcccatgatccaatttttcatgagcagcttgcttgaatgccacaaccgctgcagccagtccagacttcatgtcagttgcaccacgaccgtacaacttgccatcttctacatgtgctgagaatggtggaaactgccatttattgacgttcccagggtcaaccacatccatatggccatccacaccgagccagcgctgggcattaggattaccgatcgtcagcaccaaattatcacgaccgggcgcataactgatgcgttcccgtttaatcaatccggctttcaactcaggggctaaaaaggtttcaatcaggtctgctacctgaccttcttttgctgccacacttggtatctttaccatggcactgagtaaatcaacgacttgttcttcttctgtcaagataaggcctccgcttatgatcgtttgtatgctgcttttgtttggcttcggacagccgctcagcacaacatttaacgcttatttccgtctgaatcgtaataatgcatgacccaaaatcggcgttacgataccgcccaacaaggcctcggctacggcgttaatcgccaaagccgtcatcaataaccatcctaggttggtcgcatccgcacccggcacaatttgcgctgctttactggcaaacatcaaccatgtaaacccaatgaccagcaaggtgttcgtcaaagcaccgacaacaccggcgaaaaccattttaactgtttgcgccaacggtgtttgttttttcttgaacaattgatgaaaaataaatgccgccactaaaccaaccatgacacgcggcacgatggcgataatcggatttctaaacagcagcagggtcactggatcagtcgctgatgtatacgcccgaatcagactggttaacccccataataagccaaggctggcaccgccgccatagcctaatacaataccaccaatgatgacagtcaaatgaatcgttgaaatcgcaggccaagccggaaaaatctgcacatatccgaccattggaatataagcctgaagaataatcaaagcaccaagaataccaataatcgcaatattataagcttttccgcgttgcgtcatgcgctgctacctccaaattgtctaagtttgattttatcaaattatacacgttcgaggaaagtgatgctgggaggaagacttttaccggaaacgctagggaaaaggttggctgtcaaagaattcccgcgatggtgttgcacaaaacacgctcgtatttggaggagactacacataaagacctcataaataaatgactgaaaaccggtcattgacttatccgccggtttctaaacgcgttcgccaccccagaaacctgcgtgtaaggaccttgatcgcaatggccaaacccaggccatcacggtcaagttcgcttacactccggtttctaaccggggtggcgaacgctcttgaaaaataaagtttgactttaaatccctaatttcctataatatttcttgtgcttaattagccatgcgggcatggcggaattggtagacgcgcaagattaaggatcttgtgagcattattgctcatggaagttcgagtcttcttgcccgcatcacaaaagacccgaccaacaggacatcttgttggtcgggtcttttttgctaccttagattttcggctctacgtcaactggtgttgaagaataaatttatcatttgaggcggttctccatttggagagccgtctttgtcatgttatgccgtgatttggtagattcgtttgaagaagttcagctgattcttgaagccaaaacaggatcgtttgagtgacttgatgaggcggttaaccccttcgatcggaccgttggaataagggctggtgacagcggcgagaacagcgactttgtgtcgcttaagcgtcgcgatcgtcatgtccattgccgtaccgtttggctcgtaagtagctaacaggtttgccagttccgtgggatgtttcttcaccatcaaggcatcatgaagcgctaagtaggtctcgtaggtttgcttgagcttgggctcagtatcaagtgcgatatcgatggcctcctgttgcgtgacgtattcattcaaaccaaacaggaactgtttgtgtttagcgtcaggcgcagtttgatgaaaaagccgccagtttgtcttcatgatcttataaggacggctgtgtttgtcatcaagctgtttgagcgcttggacgcgtacctgatcaagggcacgagccgcaagttgaatgatatggaaccgatcaatgacgacttgggccttggggaaaacctcatgaataatcgtctgataagctgcattcatgtccatggtgaccgtctggacccgagtgcgttcagcgagtgaataatgagcgatgaagaagtttttaatcgtgcggttgaatcgatcaccaagcaaggcaatcagacgatgtgaatcggcatcaagacagataaacgacatcatgccatgagtagaacggaactcatcaaagcagagtcgcgtgggcagccggcgagccggtcggagtttgagattttggtcaatgatccgttgaaccgaggaagctgagattccgataatacgggcgatggttttgactggcaaccgttcatgcgctaacttcatgattcgctctgtcatgtgagtggcgatcgtgtggttgggttgcacgagtggcgtcttggcactgactgtgtggtaacagttatgacagcgccatcgttgcttgtgcaagtcaatgactgtcggcatttcaaccccattgaggacgcgcacgtgggccgtataaaacccgttagggtgcaaggcctcaaagccacacagtgggcaccgggttaaccggtaagtcagctcggcatcaatcacatgatactggcggcgacgtaccccgttgccgcgatattcatgacgaacaaaggcaactttgatattatggtctggtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttctcaacaccagaaagtgtagacccagattttctaacgaccggcaaggctctctagcagctgttttaatcaactatcatgtcacacatgtcacacaagtcattgaaaggagtttctctatgcttcgcgaagctcaatttatcgatctcggtgccattgttcacctctatcaacaactaaccgctgaaatggcgacgatggcccctgaaacttatcgtccattaactagcgacaatcgtcaatattttgccgactacttgcaaaatgaccttgctcggcttttcgtgaccgaaacggctggtactttaagtgggtttgcgcttgtcgttttggctcgcactggcgacaatgcggaatttgttccgcaacattttgcccagctgatcgatctttatgtgatccctgcgcaacggcatcagggattggctaaacagcttatggacgcggtcacggcttttgccaaaagccatgatgccactttcattcagttaaacgttttgaatgccaatcagactgccaaacaagtctatgccaaagctgggtttgaaccggtaagtctgattttgcaaaaaccgcttaactagccaacgtcttttgcaggcgcaatttaccgcgacagacaccacacgcgtatcgccgaacatcaatgtgccggcgacgaacgaattggcgaccgcaatgggtgcatacatacacgtactgatggccgttcactggcaacggtggcgcaaaacgtgacccgccaactgcagtcaagagctgcttaaagtcgtgatcgcgatgctgatagccgcgatggtgatcatataggtggtaatgcaccagctcatgtttaataatgccatcggtgacactcgcaggataaaccgcaaatagcttggggttgaagtctaagttcatatcagccggatgaaagcggccccccgtcgtttttagccgattattaaaaacagcgtgatggcgaaaaggttgatggaatgctttcaacgaaatcgcctcaacgcgggcctgtaattcttgatctgtcatatctacctccgagccaatagtttactccaagtcacccgtagttgcatcatgacattttggttcctcaaactggtcttaaaatatcaaaaacgagtcctctgagaaatggctaaatagccatctcgaggactcgtttttagtttaactgaaaaaggccaaaacatcatcacggctcatcgccgcttttttggcttggtcaaaatcagccacaattttaccagcatctaacacaatcaagcggttaccataacgtaaggcgtcttcaacctggtgagtgatcatcaagcaggtcagttgctgatcggagacgatttcgttcgtcagttgcatgatcgcctgactggtatgcggatcaagcgccgccgtatgctcatctaacagcaacagatccggtttccgcatagttgccatcaataggctgagtgcttgccgttggccgccagagagctgctcagtcggcttgtcgagggcatcagcaaggccattgcccgtcttcgctgctaaggtcttcagcgccgctttgctagccgtcatgccgcgtgatcgcaacgttagccgctgaccgcggtgactagctaagagcaagttttcggcaactgtcattcgtggtgctgtccccattttaggatcctggaaaactctggcaatatgccgcgcacgttgctccggtcgtttgccattcaaagtttgatcagccagcgtaatggtgccaccgctgactggcatatcgcctgtaattgcgttgaataatgtcgatttaccagccccgttgttgcccaaaaccgttacaaattcacctttagcaacggtgaggttcacgtcctgaagcaaagttttcacttctgtaccaacgggaatattcaccgtaacgttggttaaggttagctcagccatgtgcttgcacccctttctgcaacacgcgccgtaatctcaagcgatgatcaatttgtggcaccatgatcgcaatagccaaaacaaccgctgagatcagttttaagtcgtcggcattgaaccctagtgcaagcacaaccagcaaaacgaagcgataaagaatgctaccgagaatcacggcaaccaaacgctgtgagagtgttaattcgccaaatacaacttccccgatgataatcgcggcgaggccaatgacaatgatcccaatgcccatattgacatcagcatagccattgttttgggccagcaaaccgccagccaaaccgaccagaccattacccaccatcagaccaagcaccatctgatgatcaggatcaataccgagactgcgcgccatacttggattgtcgcctgccgcaataaacgcttggcctaactgagtatttagaaacagcattagcaagccaaccaccacaacagcaacgataacgccgataaccacactattgaagtatggcggtaaatcttttaagaacgctgtctggaaaagatttgcttgatgcaacagcgatagattggcgcgtcccataatccgcaagttgattgaaaacaacccggtcatcaccaaaataccggccaacaaaactggaattttacctttcgtggtcaacaacccagttgccaatccagcaagcatccccgcaccggtagccaacagcgttgcgacaatcggtgaaatgccatgagtaatggcactcacagctactgccgcgccaaatggaaaggtaccttcaaccgtcatatccgggaaatccaatacccgaaatgttaagaataggccaagtccgattaaaccatataataaaccttgaccaatcgctgatacgccgatactcatttgatcaccgttcctttcgcctctgccgttttgattaacgagctaggtaagtcgatgcctaacagttttgcttgtttttcgttcaagatcagtttaccggtggtttcaaaatgaatcggcgtcgttgctggctttgtctttccactcaagatgtctgccagcatccggccagttaaaacgccgagatgatgttggtcaagaccaatcgttgccaatccgccttgttcaaccatcgtgtccactgttggaaaaattggcaccttccgcgtattagccaccgcaaccaaagtttgcatcgcactggcaacagtgttgtcagtcggcacaaaaatcgcatctacttgactaaccatttgtgtggccacctgatttaagtcatttgttgaactgatcgcgtaccgcttaaccgtgaagccttgctttggcccaagtttttcgaccattttagcctgtgtttgagcggaatcatcactcgacgttgcaatcacaccgagagttttggcattcggcataatttgccggattaatttcagctgcgcggcaatcggtgcctgatcagatacccccgtgatattgccacctggccgtttaacattcttcactaactttgccgcaactggatcggtaatcgcgccaagaatgatcggtgttttctgattgacattggcaagtgcctgagccgatggcgtagcaatcccaactgttgccgccgcatgttcctcagtaaagcgttcggacatggacttcagattgctttgatcattttcggcattttgaaaatcgatcttcacattcttccctgcaacatagcccttctccttcaagccatcaataatccccttgtgaatcgcatctaatgcgggatgtgtggtcaattgcaggatacccacagttggtgttgcctgtgtctgtggtgttgtcgtgccggtttgaaaataggcaatccctaagaatgctgccataatgaagatcaaccctagcattcgtttcatgtttccgcctccgttttaaattaattcatgctgtgcccgcttggacttaatcagttatgattcataacgcgctcgccagcccagaaacctgcacataaggacctcagacagaaatggtcaaagcccagccatttctgtctgaggccacttatgttccggtttctaaacgggctggctcacgcttacaaaaattgccgcgacaggtgaggactcgtcgcggcaataaaaaagtccgcatagtcccacttttggggtatctatgcggacaaattgaacagagggccaacatagacacaacctgcgcgtctggcaggttgcgtctgcaacctacctaaagttggctttgccaagcagaaaaggtaagcaatgctgtcatgtcggtttcctccgttctaattaattgatttgttgttagattaaagatacgtgagtaaagttctcatgtcaagtataagcttaaactttttttgacaattttgaccagcttaagacaacatgactgaaattttttggatttgcttggtgaatttttgaattgcctcgtcctgagctttttcagctgcgttgaaagctgccacatcaacttgccgatccgcgtgcaaacttgcggtcatcgccttacatgcctctgtgaaagcggcaaaatcatgtacaagtgtatgatggggccccaacaatctggctggcgccgcgacttgctgcaacttgacaagcaacgcttcatagttacttgtcccctcgctaaacacggtttgcgtttgttggtaagcctcaaggtcgtaatcggccaacttgttctcatcaatcgccttgcgcagcggttcaaacaacggcgccattttctcttggttgtcttgtgtggcttcaacgaccgcattaatggtcgtcccgtagtttgctaacttcatttgctgtttattcatgtgcttcatccttttcatcggctcattagccggtaattaacgcataaaagccttgactgtcatgaccgttacaacacggacatcacggtcaaggctactcctattgttttttgactgtaagcaatcttgtggtgtcttatgcgcgttgcttgcgtcgagcacgttcgaaaactttaacgatctcaacaatgacgatcatcgccacaccagccccgagaaccgtgatccattgatgccaatcaagcgatgtcacatggaacagaccattgaaacctggcactaaaatcgtgactgccaacaacacgaaggaagccagaatcgcccagttaaaggccttgttccggaacgcgccgaccgtgaacagactttgatggatactcttcacgttgaaggcatggaacagctgaatcaagcccagcgtagcataggccatcgtcaaagcatcggcgtgaatcgcagctgagccgctgtgcactggataggtaatggcaatccagtaaacgccaagcgtcagcagaccttcgagaattccttgccagataaccgcggggccaacgccgcccgagaagaagtttgacttccgaccgcgcggcttttgcttcataatacctggttcagttggttcaacccccagtgcaatcgccgggaacgtatctgtcactaagttaatccagagaatatgcaccggtgccagcaaatcccaacctagcatggtcatcatgaataaggtcaagacttcaccaaggttggccgacaacaggtactgaatcgccttttgaatattggaaaagacttttcggccttcttccaccgccacaacaatggttgcaaagttatcatcagccaaaaccatatcagaagcacccttggaaacttcggtcccagtgatgcccataccgatcccaatatccgcagctttcaaagcaggcgcatcgttcacaccgtcgccggtcattgccacaaccttgccttttttctgccaagcattgacgatccgtaccttgtgctctggcgcaacacgggcgtatacactgtactttgccacgttctttgcaaactcatcatcactttgctgatctagctcagcgccggtgatgacagcatcatcatcgccttggtcaatgattcctaaccgaacggcaattgcttcagccgtatcgcggtgatcgccggtgatcatcatcgggcgaataccagccgcttttgcctctgccaccgcagcttccgcttctggccgttcgggatcaatcatgccgaccaatccagcaaaaatcatgtgattttcaaccgtatcggaatcaactttttccggtaaagtatcgatgaccttataagccatccccagcacacgcaacgcctgtgtcgccatgtctttattggctttcaaaatggcatcgcgttcactgtctgacaacggcgccgtattttcgccagttgctaggtcaatcactcgcttgagtaattcatcaggcgcaccctttgtggcgactagcaacttgccatctgcgcgtcgatgaactgtcgtcattaattttcgttcagagtcaaacggtacttctgcgatccgtggttcgtcagtgagtgctttggcaacatcgtaattctgggttttcccataagcaacaagcgcagtttcggttggatcgcctagtaacttaccatcgtcttgcacctgtgtgtcgttggcaaagttcatgatggtcattaatggattgccgccatgaataccagcgcttgcatcattaagctgaccgtcgtaataaactttttcaaccgtcatcttattttgagtaagcgttccagttttatcactcgcaatgatatccgtgctgccgagggtttcaacagcaggcaatttacggaccagtgcatggcgcttggccattttctgcgtacccaatgctaaaatgatggtgacaatggctggcaacccttcaggaatggccgccacagctaatgaaacggctgtcaggaacatttctggtaagcttgccgcttgacgccagataccgactgcaaacacaatcaccgcaatcaccaaaatcatgaccgtcagcgttttaccgagacttttgaggttctcttgcagcggcgtgttggtttcttctgccgaattaatcatcccggcaatgcggccgacttcagtttgcattcctgtagcgatcacaacaccgacgccacggccgtatgtgatgttactgttcatgaatgccatgttagtgcgatcgccaattccgacatcatcagcatccaacggtgccgtcgtcttatcgaccggcacactttcacctgttaacgcgctctcttcaattttaaggttggcactctcaactagtcgtaaatctgctggtacgacatctccagcttcaagtaacacgatgtcccctaaaaccagttggctgctaggaatggtcagcacctgatcaccacgacgaacatgggcgttaggggtcgacatttccttcagcgcatcaatcgcttcctcagctttactttcttggaaaacgccgaaaaccgcatttaataagacaacggccaagatgatcccggcatccgcccactcactgagtaaaaagccggcaatcaaagcggcaaccaacaagacaataatcataaaatccttgaactgatctaagaaacgggctaacatgcccttcttttctgcctgcgcaagttcatttggcccattctcatttaaccgtgtttgtgccgcttctttcgttaacccggttagactagtctgttcttgctttaagactgcctcactgcttaatgcatatggcggtttgtttgccaaagtagtgcctccttcgtatttgggccggtagccaaaaagagacctatggactaccagcagtagatccataagtctcactatttaagacaacaccagacatagccttgttggtgacgttgtcgcagaatactctgctagttactcccttatgttggttaaagtatatcaggtgcgggtcatgcttcgcaaggcttacttgcgaagagcgtgaacaggcccggtttctgggcctgcaaacgcgtttaatcagagcagagcgtgcaagtccggttagaaaccagcataagtggccttattaggaaggccattcagcccaactcactaaataggtgaaccgctaagtcatgcagattcagtgcatgcgaattgtagttgctgagcaaaatgacggcattttggccatcatgacttatcgcggttgaggccatttgaccggcgacgacaccgttggttgagtaaaagtcagcatggttataaatacccgcgttgtaaacaccatcgttgcggttacgcaatgtttttaaagttgaaagcggtaatactttccctgtatcaataccacgcaacagccggtataagtcaccggtggaagtatagacattgcccgtgcctagttctcgattataccaaactactggttcaccaatcgcagtttgataaggattagcagccgggccagtgtaagtgatagctcgctcaggatctgtcagcattgcgggtaaaaagcctgtgtgcttcaggttgagccgatcgaaaatattgtttttgacttgctgctcgtatgaacgaccagcaactttttctatcacaccagcaagtaacacgtaattaactgcttgataagcgtaattatcctgcggcagataggttaagttggcaatcgaccattgaataatattagcatcgtccattacagttggttgatacttacgcaaactaaagccgctgcgcatagccaccatcatgcgcaaagtcacttgatcgccggttttgatgccagttagatatttgccaaccggatcatccaagctgagcttgccagaagcggctaattgcgcaagcgcaaccgcagtcacggctttttgaattgaaccaatctgaaacagcgtggttggaccgttgcggcgatgcgtcgtcgtgtcggcatcaccaacaccattgttaaacacgactttgccgtgcttaatgatcagggcactgccaataaatttgtcattggtcaactcttgctcaagtggttggccttcagtcgtcgtcgcggcacgatccaaggtcatggccaatatttcttcttttgatttaccccgatcctgacgtaccgcttttgtgactgtctttgcggattttgccttcgtattcacggcggatcggctgttttgctgccacaagtacgttcccgcaccaatgctgactgcacataaaatcagcatgacgcccaaccaaatataacgatgcttacccgacatcttaaaacctactcctttaaatgcattcacaagcgcaaaacctttatgtaaggaccttaaacctaaatggccgctcctatacttcggtttcaaaccggctcagttcacgctcttatctaaacgcgcttcactggcccagaaaccgggcctgctcacgctcttccaaatttaacttttctggacgcaaaaataccacattatccagcaaaaagacagcccgtcgtatcactgattgctatcggtgatgccttggctgtctttaagcgttatttccaaaaattatcgaaaaccgtgattggtaaatgccgcttgtgggcggttttttggtaccacttttcaatcgtttcagcagcttgatcactgacgtcttttccttccaaataatcatcaatgtctttgtacttgacgcctaacgcaacttcatcaggcagcgctgggcgattgtcttcaagatcagctgtaggggccttttcatacaggtgtgccggtgcgcctaataccttcaaaagcgcggcgccttgtcgtttgtccaatcgatacaatggcgtcaaatcagcgccaccatcaccaaatttggtgtaaaagccagtcacggcttcagcggcatgatccgtgccaatcaccgcaccggcattattgccagcaatcgcatattgcgcgatcatccgcatccgagccttgatgttgcctttgttgaaatcagaaatctttgacccatcagcttcaaccgccgcgaccattgcatcaacactcggcttaatattcacacgcttgacaacatcagcgtgcataaagtcgatagcagccatagcatcggcttcatcggcttgttcaccataaggcagacgaacggcaataaattgataagcatcgtcgccggtttctgctcgcatttcctgcatggccttttcggtcaaagcaccagcaagactcgaatcttgcccgcccgaaatgccgaggacataagtttttaaaaaagtgttctttttcaaataagcttttaaaaagtctacactacgacgaacttcagtttccggatcgattgttgcttgaacacccaatgctttgatgatttctgcttgtaatggacgcatagtcaaactcctttaatcatattcagatacaaatttttaatgagaccttgggttatcttgtccgtgttggcaagcaagacaaccgcgttttggccgctggtatcaatcatggtacctgcagattgcgaagccaccaccccgtgcgttaaggtgtagcttccaaaattataaacccccgctgtgtactgaccattatccaaattccgcagtgccttcaatgaagcagttgaaatgattttcccctgattcaccgccttgatgatctgatacaaatcacccgcacttgtataaatattgccagtacccagttcccgattatagttcacagaaggctctgtgtaccgttttgcgtagggattattaatgggaccactataaccaaacgcctgattcgactcgtgaaacaactctggcataaacccagagtgagtcaatttcaacttcttgaaaatttcctgttgaatcaaatcggcatacagtcggccagtcactttctcaatcacaccagccaacaaaacataattcactggttggtaatcataacgaaccgttccataatttaagttggcaatcgaccaacggacaatgccagcgtcagaaagcgaagcactctgcgcacgcgtcaatgataagccgctacgcatgttgagcatcatgcgcaaggtgacttgcttgcctgtcctaatgccggtcaagtacttactgatcgggtcagacaaatgcactttgccttgttcaactagtcgcatgagcaacacggcagtcaaccctttttgaatcgaaccaatttgataaagtgtctccggaccatttaaacgtccagattcagcatcggcatagccaagtcctgtgttcaaaataatcttgccacgtctgatcatcaacgcagtaccactaaaatgattagcctccaatattttcataaacggcttggcttccgcctgattaactggctgcatgagcttgtcagtcgcggatgtcgctgttcgcgtttcattttggaggcgttgttcaaccgcccgatgtcggttcaattctgtttcatacttgcgccgagtccgctcttccttagcctcaatctgtggcttcaaataaaaatgatcgtaactcgcataagcagctattccaactagaagaccgactagtaagctaaggattagccaacgatgctgcgatcgccttttcgatgccctcatagattattcctcgcggtcagccaccgctgatttgactgctttgatcagatccatcttgttgtcccaaacccgttgcgacaagtctaccgggtagtcctgtgggttcagaatgcgtcgatattcatcccataatgcgttggtactccgagtggcatatgcttggacttcttgtaacggtggtgtgtgataaacctgctggcctttgtcataaatcgtctgtagaagtggcttggcttcaaaatttttaaccgttttattgatgtacgggaagttcggatggaacatataaagacttcgttgtgtatcaatggtttcatctgccaaggcaacataatcgccttcagatttgccatcatcttgacgcgtaatacgccaaacctgctttttgcccggcgttgaaactttctcagcattgttcgacaatttgatcgtgtcgcgcattttgccggctgcatcttcaattgataccaacttaaacacggcgcccaatgccggctgatcataggcggtaattaaacgtgtcccaacaccccaaatatcgattttggcaccttgcatcttcaagttctgaatcgtattttcgtcaagatcgtttgaggcgtaaattttagcagattcataaccagcatcgtccaattgttgccgaactcgcttggagatgaaagccatgtcaccactatcgatccggacaccaagaaagttgatcttgcctttaaactcattcgcaactttgattgctgcaggcacaccagaacgcaaggtgtcatatgtatcaacgaggaaaacaacatccttattgctgcgggcatatgctttaaaagcatcgtaatcattgccataggcctgaaccagtgaatgagcgtgggtcccactgataggaataccgaattccttacccgccaatacattgctagtcgcattgaagccgccaatataagcggcccgtgtgccccacaaagcagccgccgtttcctgtgcccgccgtgtgccgaattccatcagggggtccgcaccagcaacgctgcgaatacgggcggctttggtcgcaaccaatgtttgatagttgatcatattcaaaaccgctgtctcaaccagctgtgcttgcgccaatggtccctcaatttgccaaatcggctcgttgttgaataccaagtcgccttctaaagctgacttaacagtgcaagtgaacttaagatgccgtaaataatcaataaaagcatccgaatagtctgtttgcgactgcagataagctaaatcatcttcagaaaacttaagatgattcaggtagtccatcacatgttccaatcccgcaaaaacagcaaaccccgaaccaaacggtaaatcccgaaaaaagacttcaaacacggcattgcgttcgctaatcccctgttcaaaaaaggtattcatcatatttaattcgtaaaaatcggtgtggagtgtaagtccttcacccaactgtgtggtcatcatggctccccttccggataagtggcaacaacaaacaagcgctcgtataggcgcagtgatgcttaatttatagttcatcattatataccattcagagaaaatgggacagagcgcgaacaggcgcggttagaaaccggagcataagtggcctcaagcctaaatggctgggctttggccatttaggcttgaggtccttatgtgcaggtttctgcgcctgttcgcgcgtttcggaaccagcacactgacggctggcctttgcccattcctgtctgaggtccttatgtgcaggtttctgcgcctgttcgcgcatttcgaaatcagcatagcttaggctcagattccctttcaaatagcatcaaaaccaacgaaaaaagccaaagaacaagatgccatcttgctctttgacctttcccaatgcctagtgtttataaccaagcagcaaacattaccgttctagataaaattcaaatctttcgccaacatactgcgttcgaacgtattcaaacggcgtaccgtcttgcaagaatgatacctgacgcaaacgcaggatcgcttcgccacgcttgatgtccagatactctgagattcgttcgcttgccagcatcgcactgacagtctgttgcgcaccgccaagcacataaccgccttttttctccaaggtatggtaaaaactggctgtcatttctttcttggtaaagtttttgacgaggttgtatggaaccgccgccgtttcaaagctaatcggaatcttatccgcgtaacgaatccgttccatgcgcaagacttgttctttaggctcaagtttaagtttttcaacttcagaacttgttggctgggccacgtggtaggagactgtcttactggatggcaccttgccttgtgcttgcatcagatccgtaaagcttgtgacgccagacattttctcttggactttctggttggcaacataggtaccggacccgacgcgccgttcgagaatgccttcatcgaccaatgtttgaatggcttggcgcaacgtcatccgtgacactttaaacgtgacagctaaatcacgttcagaaggaattcggtcgccaacgcgccatttgcctgcttcaatatctgcccgaatcgcgttatgaatttgaatataaactggtgcatccatgaatgatcgcctccaaatcgtggttcagtcttcggtgtcgtgtttaacgccatagctgtaggttgcaaccaaatcgttattgcgatccaaaacgttgatatcggcatctttcccgacttcaagcgtgccttttgatgtcaggttgaattcccgtgcttggttgaccgatgacatttcaacggcatcaaacaaggaagcatccatgaagctcatcgcattcttaaaggcatctttatacatcagaactgagccggcaagtgtgccgtctttaagccgtgcctgcttatctttgacataaactgtttgaccgcctaattcactcttaccttctggcatgcctttgctacgcatggagtcggtaaccaattcgattcgttctggtcctttttggtcaaaagcgaggcggagcatatcaggcacgatgtggaagccgtcacagattaattcacaatacatgttgtcttcaagcatcgcatgaccggtaacaccaggctcgcgatggcgcaggccgcgttgagcattatagagatgcgtcacatgtgttgctttgctatgcagcatctgttcgcgggtagcgttactgtgaccaacagaaggcacaatgttgtgcgccaacaagtagtcttcaaatgcttgtgacccttcgtcttctggcgcataggtgatgagcttaaccagaccaccggataattcctgccactgtttcactaaatcaacattaggattcttgatatattcttcaggttgggcacccttgaagaccttactgatgaatgggccttcaagatgcacgccttgaataatgtggttgcgttcagccgcctgtttaacgccacgcatggctttgtcaatattctcagttgactgcgtcatggtcgttgcaaaaagggtcgtcaccccttcgtgcgtcatcattttcgttgccatttcatcaatctgatcggcatcaccgtccatggcatcaaagccataaccgccgtgagcgtgaacatcaataaatcctggaatcaaggttttcccttgaaggtcgaaagtctgttcaccagattgggcgcgataatcaaacatgtcgccaactgccaaaattttgtcatcgaaacgaacatagccgtcatcgatgcgttctaatccagtatagatcgttgcgtgtttcaatactgtaaccgtcacaataccactcctaattgtttaatgcttcattcgacagataacatataccagtataactggtatagaccaagattacaagctataccttcgtcgtacaacgtcatacttatccttgacgatccttagcaatggttgcgtccactcccttgataacggcagacatgagccctgcttgctccatcgccaacaagccagctactgttgtaccacctgggcttgagacttgatcaatcagatcaaatggcgattgctcgctggccaaaacattttgggcactccccatcactgcttgagcagcaatggctgttgcctgttttttagttaacccatacttaacgccagcccgcgataggctatcgatgaataagtaaacaaaagctggtgatgaccctgccaacgcgacaaatgtcgaaaattgatcctcaggtaacgccatagttttacctaagacgttcaataagtccagtaagccatctaattgacccgccacactatcattagcagcgtaagccgtcatccccgcgttgatagccacattcacattaggcataattcgcaggaccggttgatcttgactgccaagggcatcttcaagggtcgccagtgaaacaccggtaagcatcgaaacaatcggtacctgccgttgtttgagcgttggcccgattgtctttagaatcggcacaccaagtttgggggcaacagctaggaaaacgatatcggcagtgtctgcaactgcctgattgctcgcgaccgctttggcgccaattttggcggcatacggttcatagtgaatcggttgcccgccatgcagaacaatttcctcaggcgtgaccgcatttttagctaacaaaccagtgatgatcgcccgtgccatattgccggcaccaataaatccaattgtcatggcctgcctcctttatgcttgatgactttcttctgttgctgaatgggtcttgaaccaatcgacgagggctgctaatcgcgctagtcgcagattcggtagcccgctgcgagacagttcatgcgtggcattgggaaagcgcatgaacttagtatcaacgccatgcaacttcaagccaatataaaattcttcgccttggccaatcggacagcgttgatcattttcactgtgcatgaccaacgtcggggtttgggcaaagtcgatatgggctagcggtgaaaaatcccaaaggcttttcacatcagataaatcaccggtccattttccttcgagttcccaaggtgtgaagaagtagccgatatcacttgtaccgtacatactcaaccagttagcaatggatcgttgggtaacagcagccttaaatcggtgagtatgcgtcacaatccagttcgtcataaagccgccgtatgatccgccagccacatacaaacgatcaggatcaatggtggtatccaacttcaaggcttcatccactgatgccatacaatcctcataatcgccttggccgtaatgtttaatcacggccgctgtaaaggcctcgccataccctaacccaccgcgcggattcgggcagatgacgccgtagccttgagcagccaagaactgcatttcgtggaagaaggtatacccataaccaactgccggtccgccgtgaacatataaaatggctggatgagaagctgtcgcctgctgtggcgggaaataccaaccttcgatctcgaaaccatcgcgctggaagttaaatgtttgtggcgtcaccaaccccatatcgcgtgttacccgacgattgggatcataaatcacgtgttcttcttcagtcgccaaatcaaagtagctcaatcggcttggaaccgtcattgtgctttccgtaaaaacaaccccgtgatgatccggcgttaaagcgtaatcagttacatgccgacgtccgccaatcaaaggtgtcagctgctcgtcggggccgcctgcatacaagctcgttttcccgtggtcaaaaccaatcgtcagataatagtcggcggtggcaaaatcagccactttttcagataaatcctgttgaaaatcgccattaacgtgtcccggaatatcaaaatcaatatcatcggcgacatcttgcaacgttttggtcgctaaatcataatgccacaagtgactttgcgacacatttggcagatgattgtccgaccccacaagcagcaattgcttgccatctgctgaaaatgcttctggcgataaggccgcttgcggtaactgatcattaaccatggttacctgttgatcagctaaatttaacaaataagttgcttggctaaaatcatttgggtcatcgggcaggcgctctgcagtaaatgccaaggtctgtccgtctggagaaatcgccccgacttcaaattcatgctcccggcccattaccaaacgactggtcttttgacgcaggcgttggacccgtaattcataagcgacatgttctggtaataagccgactccatttaacttatagggcacacgtgagaccgtcaccggttgtggccactgcttatccgtctttttcggctttgcgccaactgtcgtctgaataaacagtgcttgactgtccgcttgccaaccaaagtaggacacgccttctttttcagcagaaaattgcttggcagtaccgccattgaccgcctgtacgaaaacttgagtcgttttatcggatgcttgacttaaaaaggccaaccattgctgatctggactaagcagcggatgccgatcatgtttttgatcaaagccatacgcgatagtgccgccacgatgattgacgaaacaaatgcgctgataataagtattatcggcctccgaaatgcgattttcctgaacaaagtagccatcatctgtcgcacttggatacgacaatgataccaatttaaaaagatctgtcgctttaattgccatacgatcacgcccttcctcatattgctttaagcgtagcggttgggctataccatgtcaattagctggaccgcttgaaataaaaaaaacgcatggcctccgccatgcgtttacgtcttctatcgaactttaatactggatggaggagataggattcgaacctatgaacccgaaggagcggatttacagtccgccgcgtttagcctcttcgctactcctccgtgtgattgctgcgaatcaacttaaatagcatacaaaaatgcgattcaaaaatcaacagcatttgcctgatttttgaccgcatttttcgtatccttaaaggtgatagcgttcaagacaacgttggcacggttaatgtcacaagcgtctgccgccattcagtccaccaatcttgactctgccactcgaataatcgttttaagccatatccaagcggctgatgataatacgtagtaccgcttaaaagcttaggtgcatcgcgaaaatgctcatggccgaacaccactgccgacactttacctgtcagcaaatcgccgagtttggccgaccccattagcgccgttgccatctgccaaggcggccgatcaactgtatacaccattgcctcacgaatcggcacaaaatgcgtcacataaatcatctggtgcgtctgattcgcttgcagcgccgccttcgtggtggtcaaaacccgttgcattcgcgcagcatcagtgacaggcgcgtcaatggcactatcaatccaaaaggcgcgtttccattgagcatattccgcatcggttttcatattgcccagctgtcctagcgaataatcataccagccattgttgccaataatgacagcattggtgctaggcaccggcaaaatcttttcatgcagatacagcggatcaaccgctgattgaatttcatcgtacgttgcaccattcaccatatcgtgattgcccgccaaaaagcgaatggtgactgcagacccaacttctgcctgcagtgcgcgaaaataagccaatgatttggtgaagtcattgtaagtatcaccggcattcacatagatctgataatcatgttcaaccagataagcggcctgcttcttcagcatctcaaagccatcgacgcgattcacatcaaaatggttgtcaacactgaacgcaattttcaccatcagcgcacctccaccaaattttgtcagcagcatggaccaaatgacgttgaagcttcgaagcctaattaacaccttgcattaatttttcgatccgtggtgtgaagaaggctaggacaaccgcaaagccaacggacaccaaacccacaatggcgaaataagccacctcgtgatttggcgtataaaaccggacaatctgcgcattcacggcttgtgccgaggcatcagctaagaaccacatgctcatcatttgtgacgaataagctttcggtgccagtttggttgtgactgacaagccaaccggagaaattaacatttccccgatttcaacaatcgcccaactcatgaccagccataatggtgaaactttggcgctgctgccaaacagcatcactgggataaccatccataaataagaggcacccgcaaaaatcaaaccaagataaaactttttcggcgatgtcggttgccgtttaccgagtttcatccataaccatgcaaaaagcggcccataaagcaaaataaacaatggatttaaagtttgaaaattaccagggagaattttaaaaaagccaaaatccagctttgtctgttgggccgcaaaaagcgccaacacgacagacccttgttcttcaatggcccaaaaaatcattgctgctaaaaacagcggaatataggcaatcacccgtgatcgttcagtcttcgtaacttttttactacgaatcatgagcacaaagtaccaaatcggcaagccaatcgcgattaaggtaatcaggctgatcacgttggcaatcgtcagcgcattgaacccagccatcgccagtaaaatgacaccaacagccgcaatcgctaccaccacacggatcaccaacgggcgaacatcttcaggcttcaacggatcaggagcagtattgtcagctgggttaatatatttacgcccgtcaatcacgtaaaagatcaggccgacaaacataccaatggctgctagcgaaaagccagcatgaaaattgactttatccgccatccacggaacaaaaataggtgcaatgagcgatccaaagttgatccccatgacaaagatactaaagccagaatcgcgtcgcaggtcatcttccggatagagactaccgaccatttcagacacattgggttttaataagcccgtgcccagaacgattaaaacaatcgagccaaacagtccagtcgccccaattggcaatgacaaaacaatgtggcctagcatgatcaacacgccgccccaaaaaacggttcgccgtgagcctaacaaccgatcactaatgaagccgccgattgtagcacttaaataaaccagtgacccataaatcgacatgatcgataacgcagtcggctgatcaaaacccaagccgcccttctccaccgcgtaatacatgtagtagatcagaattgcccgcatgccatagtaactgaaccgctcccagaattcagtcatcgacagggttaatagcccccggggatgccccataaacgtgcgatcctttgaattattcaattgaaatacatcctctcactaggaaatgatcccctagctgctctcatggcacttccctcaaaatgccaatcaataaactatcattatagatgtattttttggtgaagacaaataggcaagagcgtgagctggaccgggtagaaaccggagcataagcggccttgggtgtgatggccaggttttggccattgcgcccgaggtccttatgtgtaggtttctgggccagcgaacacgtttatgtgaagcgtaggcaggtccagttaaaaaaccagcaccaaagcaaaaaaactgagtcaacattcccagatgaccgcctgtccgccaaaaaacggtgtgtggcgcaaatcatcgagatatgttgctcagttcttttacctaaatatgcgttaatccgcgcgtaaagcaatcgcagcgtctttgttggctgccatgcgggcgggaatatgaccgccgaggacagtcaggatggtgctaataagaatgaggatcactgcatgaatcggattgagttgagcgacattcggcaactctgtcatgctataaagaatggcattgattgggaaggtcaataaccacgcgataatgatccctagaataccggaactaacgccaaggataatcgtttcagcatcaaacacacgcgtgatatccttacgccgtgcacccaaagccttcagcaccccaatttccttcgtccgttcaagcacggaagtatacgtcagaattgcaatcatgatcatcgaggtcaccagtgagatgccagcgaaggccactaggacgatagtaatggctgacataatgccaccggtcatgctggaaattgtccccgctaaatctgtatagacaacctgatcggcttttttcttaccgcgattgaatttatcaagataactcagaatcttgtctttatccttgaaactggttggataaatcgtaatctgcgtgggtgtttccgaaccgcctaatgccgtgatcaactgatccttagtcgctttgtccacactttgattggtaaagatgttcacgtcactggctcgttgtgccttgacgacatcagagtctttgttcaatgccacaagatcttttgttaaccgatcagaataagcaaacccttggctaagcaagccatcacttgttttcgagcgcgtccgcagaacaccagcaaccgtcagttcgcggttgtcgttttgtttataagcatttgcgtaatctttcgttggaacatagacattgccagcaacattctggtaataggcattattcgagattgccttgatcttagtgccaacaatctggttaaatttcactttttgaccatctttaacatcaaaaccgaggttcttcaaagcattgatgttcgtcgagttgtcccgatcaacaatcagaataacatccccatcatgcttcggataactaccggcaacaacctcataatttttcttcagataactggtaccgccttcgcgatcaactggataaactgatgaactagcgctcgccaagccacgttgagtttgattactgcttggcttagctgtcgaaaattggactggcttgatggtaccattcacgtcacgtaacagattcataccagtgccataagtgtagccaatgttgtcagttagttttttgctaatgccattcacataatcaatatacttttgatttaacttattggtgtgctgcgccttatcactagcactttgcttagctacaactgttgaggttgttttaaaagtcgatgtctttgtattatccgccgctcctgctgttaagctagtagcgttagtcgagatcgtaatcgggaattgcgccaaagtctccgcttgcgtattatcaatctgtttttgaaagcccgaggaaagtgctaaaaccacggcaatgccaataatcccaatactggaagcaaatgccgtcaaaaaagtgcgaccttttttggtcataatattagtaaatgacaatttaagcgccgtgaaataactcattttggtgcgatgcaggtcaaagctggcagttttttcttcatctttgaatggccgtgagtcagaaagaattttgccatctttgaattcaatcgtccgttctgcatattcatgcgccagttgaggattatgcgtgaccatgattaccaaccgctcgcgagataaatcagcgattaagcgcataatttcttcactagtttcggtatctagtgctcccgtcggctcatcggccaatagaatcgacggctccgagacaattgcacgcgcaatcgccacccgttgcatctggccgccggaaagttgattgggttgcttacccatatgtgccttcaaaccgaccttcgtcaaagcagcctcggcctttttacggcggtctgctgctgacacaccactcaaagtcagaccaagttcaacgttttccaaaatactcagatgcataatcagattgtagctttgaaaaataaacccaaccgagttattacgataggcatcccaatcggcttctttaaaatttttggttgatcgcccgtgtaagagcaaatcaccggaatcataacgatcaaggccaccgatcacattcagtaacgtcgttttccccgaaccactgggacccaaaatggcgacaaattcttgttcccggaattgaactgagacatcgtcaagcgctttggtcgtatagtcgcctgtctggtaatattttttaatatgttttaagtctagcaatcgttgttctccccttaatgcgttttctgaaatagaaaatagttgaaacgttcgctcgcaatcgcgatccccaagcgggtgttaacggctaatcactgatcgcacttttctgcctacgccaaatcacgcgttatattaatggtgcccgtttatactttggaatgaaataacttgccatatcttagcatacttatgaactacttgataatcagcccatggtctgaattggtgcgctagtcaagaaacgcgctactgtttctcaatgagatgtcacccgcaaactaatcatgccgctaactatcgttgcatttaaacaccaacgatgagtcgataccggtcatgagcaaaaagtggatacgaaaaaaccgagccgggctacctgttcaacaggtttgcggttcggtgaatgcatatgtcagcattaattaagtgggctccctcagtaacggctgccaataaatcaaatccagactatgatccggatagatgtaataactaatatttaattttgcgaaaggattcgccattgcggcaagataaatgggttgcggagcgtgagccaacccagcgactgcgaccagaatatactttgccatctgctcaaataaaggttgtgtgagcccagtggttagctgaaattccaagtcgacataaatgagttcgcgggtttgtcgagtaagcgtgatgcgatgaatcggcatgccgccaaaattaccttcacgattgagatcatcgaccatgcgcttaatttgtctgtgcttaaactgtggccgcgcaaacatcatgcgccaaactgccatgccgtcatccccttctttgaacgcactcgctggcgcagaaacctgcgtggcacgatctcaatcacgttgagacttcggtttctaaccgcgccagttctagctttgcctctattatgccacaaagaagcaggtgatcggcttaaaaaattgggtcgaggatttttgagaaagctgtatcgatctcagctcgagcagcctgttgttcggctaaaccagcggcaaatcggtcatgatctactttgtcagtgccgattgcttgaagcatgttcaaaacaccgccacgaataccgcgcaaaccattcaccagtactttgtggaaggccgcataattacaaggtgctgcttccgcatccacactgtcaacgaatgtacaaaatttcatcacattcttggtgaagtacaaacgcaaatgatcgagactttcacttgcatagcaatttcctttctcgatgtttttgcacgtgtgcacatattccttaaaaacggtttcaaaaacaagcagtcgttccaagttctggttcacaacttcaacatagtttggttcttggcatcgtgtatgcatttcatagtccccctagtcttgtgacttcatcaacttacgctcttaattatacccactaatgtcttataatcaatataattattgtctaatatttaaatacctaacgttatataaccctccaaaagcctattattattacgatttgcaaacatgacagcagtctgtgaaaacctttttctttgatattgcacgcaatctattcaattatgaaaacttgttttatttgagttgtgcccccatgtcttgacagacaactaattgtgattttcatgtttcatggccagttgcactgaaaataagataacaaaaatattttttaaatattgacaatttatatcttaatatttgacttccggatgcttgatctgattggcaatttgaattttgcgccattagttgttaattcagttactttaaaagaacctttcaacaacgtttcctcgcaagttcgcagaacatcacctataatttaatcaagctgttcggtgttatccatacaaacatgggttacgcactctggcttttgcaagcgcaccgagacggctatctgggaggaacgttatgaaaggttatccaaagcaatatccgctcgatcgacagactttatttgggatcaacactatggggttaatgagcacaacagcttattatttatacacggcagttctgatgatgttcataactgactactcagggatctattcgggtgtacccggcaaagccgctgctgtggcaacgaccctgttatttgttggccgattatgggacgctgttaacgacctctggactggctatctgatcgatatatcgccgcgaacccgctggggaaagtttaaaccatacgtgttaataggcagtttgttagccggtattttgggtatgatgctttttcacattccccaaaacttctccaatttcggtaaagaggtttacctctatatcgtttattttctctttatgtttgctgccacgattattgtgacggttccgttgaccagtaccatgtcagccgaccaggaagtgcgtgcaaagttaatttcatggccacggatcaccagtaatattgtcggggtggttttcgccttcttcatggcgatcgcaacgtatctagggacaaagcgcaaccccaatattcccttaactgtcgatctgatcgtcataccatttctgattttgtcgttgatcggcattgtcatggtcaaagaaggtccggttaccgaggaggctaagccgccaagattgcgagatattggtcagatgatcaagatcaatcaccctttccgtatcaacttgtactttacctttgtcggtgggtttgtttgggcattactgaccgcaacctcgctttattacatcaagtatgcctttggggtgaaaaatctcggcacacagtccatgtattttggcctgctaaccttgatcacactagtcgcaggcacacttatttctcaaaaagcaatgcagtacatttcggctattcgcggtgttcagtggtgctatctggccatggcaccgtttctagtcatcatgtttatcattaatgaaattcatgtcattgataatccgtgggtcttctacttactcatcggtattgtcatgaccatcgctggagcacagtttgtccctgccaatttaatcattatggaaacaatggactacaaccgactcaaacttaatgctggtatggaagcgactatcaatgccgtgaatatgtttctgcaaaaactgcaatcaggactagccacaatcggcgtcggtgctgcactactgatcgttggttacaacgcccaaacgctcgaaaaggcaacgcatgtgccagacaacttgttgcaaagtttaggcgttgtcctcttcgctattcgtgctgtgttttcttttttagcctatctgattgcccgccattatccattgcaaggtgccgctcgtgatgagatgtacgctgctctagctgctaaacgggtgacgaatacgcagtcatcaaaatctaaatgatgcatcgatcaatcatttaactggcaacactttttcgacctgagcagaagtgacagctttcgccgtgtatcatgctctcaaggagacgatcttcatgaccaaaccttcagctgttaatattcatcgcactaatccaccagactggtttaaacaagcggatttcggcatcatcattcactggggaccctatagtgtgccagcttacgcgccagtcaatattcctgattacggcactttaatcaaaaccaaatcattaggttatttgtttgaacatcaaccttatgcggagtggtatggcaacagcatgttattgccaaacagccccgtagcagcctatcaccggacgcattatggcaacacctcttatgcagatttcgcaaaaacgttcaagcagaccgcccagaatgtcgatgtgcaggcctgggccacagcatttgccaatgctggcgccaaatatgtcgtgatcgttacaaagcaccacgacggctttgtcatgtttgatccgcacaccaagaatccgtacgaacctgactatcatttgaacttcgactttgtcggtgaactggcccaagctgttcgtgcccacggaatgcgttttggaacctattattcatctttattggactggactttcccgcatctgccaatcaaagattacggcagctttctattgggcaacgacaaaagccaaacttacaaagattatgtatggcatcagtggcacgaattgattgatcggtatcacccagatgtgctttggagcgatatcggctacccagatgatcaccgcttggaaacgctgttcaagtattattatcaacaagtcccagaaggtttagtgaatgaccgctggcaacaatttcctgattggatgcgaaccagttggatacgacctattttcaatctcgttgcagcgcaggtcattaaacgtgaccaacatcactcagacgatctcagcgaggttaagtactatgactaccgcacccttgaatatcgtactgactggccgcaaacaaatcgttatttcgaaatgacacgcggcatggacaaaagttttggttataaccgcctcagtcggccagaggactatattactgctgatgacatcaagcaattgatcgcagagcttaggtctaaacgcggtcgacttttactcaatgttggtccggatatgaacggccaaataccatctgcccagctcagcattcttcaacagttaagcgataagtagtggcgtatctaaaatcatgcccagtttcctcgtcatgatcatgcaagtcaaaaagcacctgaccgcacaaaaacggtcaggtgctttttcatgtcagtagctgaagccttacccaagttgattaatagctgtccagctagccaacgcttcaggtcggaaaccgctccatgttgccaatacatcacccgtcgcatcgtcgcgaacgcgcacaactggaaaacgatcatatccggcctcacgaaatttgacaattttttggtgactccacgcccgttttaacggatcattggcgttaatatcaacaaggtttgattcacctcggtggttcgtcgtacgaaaatgttgaccgtgttctgcgagccagcgtttggtgagccggcatgactcgcagttaggcttttcataaatcacaaaatgaatcgccatacgctgcactcctttgcatgacgctgccatctttttagtgcaatgggctgcgtgtattgaggttagctttactatcccctattttaatcattcatgcaatgcgtatgggtttgtccatggttaaatgatgacggttaccatcctaaaatttggggtgggtctaccttgctcacattgcggcggcttgttggtcaagggcagcgatgacgtcttcaagcgctcggctggcatcaataggcaaacgatcataaccatcatggtcaacgtctttagtcgcaataaacgccaacctatcttccaaacgttgacggagacgagcgcgataatcgttgtcgccaaaatcaacattaaaaccggataacggcagataccgcatctttggtagcaggccaaatggtttgaaggcagctgtttcgtcaacaatcttggcaatcgcgcctaacgtatcggctggtttcacattttgaccgttgtaagaaccagtattcaaaatataacaagctgtttggcgttgttcaaagagttggtggaaatcttgataatcctcccccaacggatagctgcggaatgggttcgcaaacggttcgatgacaagatgatcacgatcaacatcaccgataacgttttccgctgttgagcgtttggttgccagcgtcacgccaaaagcagcggcaagatcaggatcttccagtttcaccaccggcggcaaggtatcatccttcatgatccagaaaatagcatcgatactctccgtaagatgatccacgcgattcggcgtgacgtaacgtgacttcacggttcgtccattgccgttgcgaatatcctgcgtcaccagtgttttcttaccagcggcatctagggtcactccaacattttgaaccgtcagaaaatactgaatgcccggatcactcaacggataatcctgagttttatcaaaatatgaaggctcaagcgccgttgttgcacccgtttgtcgatcaatcacaaaggcatcgtcatgtaagaccttcacgggatactgatcgccgtgactggccaacgtgatcgttgacttgccggaaccggacaagccaaacgctgccatcgtaaaatcgccgtcctgtcgcgtatattgtttcataccgccatgacaggcgacaaaaccattccgatgcgccgtcgcccacgcaagcgtcaacgtgccttttttcaactcgccaaagtagcgtaagcctaacacgatggcggcattatgcgttggatcaaacacggccaacccgtttggatacgccggatcatgccaatcgggatcggcataaagataaatatcatcctctgggagtgggcgcgattgttcatattcagcattgcgttgcggcgtatcaatttgaaaattcagcaagtacgtatacaaattatttgcatacgcttcaggcagcatcaaatgcgccttgatagcaaaatcagaggacaagccaaccgtgacatccccacggagaaaagtcttgcgactccctaaaaagacagcttcccgagcaatcgccgccagcttagtctcatccacgtcaggctgaccaataatctggcgggcagctgccgtccgaccaactacacggccatcattagccactaacaccttggcatctggcggcaatcccagttcaggcgtatgtttgatcggtaaatccgtgataatcacacccggcgctgttttggctaaagcataggcttgggcgatggtagtaacctgcttcacattctccccgtaaaatgctgtttcaaccgtggccttaagcgctgaaaaatagccgctctgactggtgatgtcactgcttgaaaaactttgcttacttgtcatggttgaatccccctctttgaacgtgctcttcagcccacgctgaatcacgcactatctttttaacaacatggatgccaaatgaaaatgtttacatggttcaattataccgagacgaagcagcggacgcgagttttaaaaaacccaaactagcgatttgcttcactagtttgggctcgcgcgttgttagctgtgatacgttaaaaaatcatgcgggttaagccttccgccgattgttcgcctgcaccatttttgcatgatcgatcagcgggcatccgacttcttcacattggctacaaccagccttattttttttgaaaaatgtacggtatgctacaaccgcaataattaaaacaacgataccgccaataatccatgttgccatgagctaagactcccttttttaaatgagttgacaagttaaaaacttgaagcaattgccggaaccggccgtttgattaacagcccataaacaatgagcaaaattgcgactaaaactagcccgatgctcatgacactggcttggccggataccacgagactgccttgataaatcaacatcgtgagaagataagccacgccagtttgatagcccacggcacgccatgtccaccgtgcatcaccaaactccttgtacattgtaccaatcgccgcaaaacatggggcacacagcagattgaaaaccaaaaaggcatatcctgccatcgccggataggtggcgcgcaaagcctgaccaaagccgctagcactgcctgccccaaaactgatatgtaaggtaccgacacaattttccttcgcgatcaaaccagctaaagtggccacggtagcatgccagtcgccaaaacccagcggtgcaaaaaccggtgcggtcaccgtccctagcccccgcagcatactgtcattttcgtcaaccatctgtaaaccgaaattgaaattagataagaaccacagcaacacgcacgacagaaagataatagtccctgctttctgcacaaaagcgcgtgcccgcgacatgacactgcgatacaagttggttaggcgtggcaagtgataggctggcagctccatcacaaacggcgctggtggaccagcaaataaggctgtttttttaagaaaaatccccgaacagatcacggcaatgatccccatgaaataagcggatggtgccacccaactgttgcttggaaagaacgtgccgctgaccagcgcgatcaccgtcaacttagctgaacacggcataaacgtcgtcaacatgatactcattcgccgatctttttcgctttcaatcgtccgcgtcgccataatcccaggaaccccgcaaccagtcgctattaaaattggaatgaagcttttaccgctcagattaaaccgatgaaacagccgatccatgacgaacgcaatgcgggccatatagccgcagtcttctaaaatacccaaacatagaaaaagcatcataatctgcggcaagaagcccaatacggatccaataccgccaatcaaaccatcgacaatcagaccggatagccatggggcaacagcccaacttttcaaggtgccgccaacgacacttggcagccagccaccaaaaaccgtgtcattgagataatcactgccgattgtaccaatggtttgaatcgataaataataaacggcccacataaccaacacgaatattggcaaagccaaataccgatctgtcacaatgcgatcgattttgtcgctcatcgacatcacaaagtcatctttgtcaaccacacacatcgcaatgacgcgcgcaatgaagtcataacgggcattcacaataatgctatcggttgtatcatcaaacacatgctccgccgtccgtaaaatttcattcatctgatgttgctcgtctgaagaaaaggccaattgcttgaccacttgcggatctttttcaaaaaccttaatggcataccaccgcaaccgatcggcaggcaccttctggtcaatcacatcttcaagcatcgtcagcgccgattcgagtcgcgcatcatactcaggaaaggcataaggctttggtagcggcgcctgaatggtttgcaccaactcctgtaaagcagccggtttagttgctgtcgtggcaatgacaggcacctgtaatgcgtaactcagcttttttaaattaatcgttcgatggcccgttttgaccagcacatccatcatgtttaaagcgacaattaacggccgcccggtttccataacttgcaacgtcaaataaagattacgctcaaggttggttgcatccaccacattcaagaccaagtctggttgatcatttagtaaaaagtcgcgcgtcacgatttcttcactgctataaggtgacaatgaataggtgcctggaagatcttgaataactaaggcattatccgctttcagccggcccgatttacgctcaactgtcacccctggccaattaccaatatgctgcttagcgccggttaaggcattgaacaacgtggttttcccgctgttaggattgcctaccaatgctaacgtttcacgtatcgccatcgcttgtcacctccgtcaccagcacatgtgccgcatcctgcttgcgaatgctcaatttgtaaccacggaccgctagctcaatcggatcacccaaaggcgcaatctgatgaattttgaccaacgtgcctttggtgagacccatatccattaggcggtgacgcaacggtggatcccctttaatcgtgcggatcaagcctgcctgccgcaacggcagatcagccaaggcaatggcaggggtatcagcatccatggcaaacggtcgaaccatgagtaacgaggcaatttcatcgctaattgctaatcgctgaccttgaaaaaaaatcaccatgcctgacaacttgcttgcaggctgaaccacggtcacttttttgcccacgactaagcccatttcggcaagatgccgccgcaaagcgccactgccaccaacgctcatcagtaagtaggcgcccgattcccgtacatctatcaaggcctgcatcgcactcatcccgctttcgtcaccaattttgtgctactggtagcatagcatgttttcgcacgagcaaggaaaaaaatcaaacaaatgctaatctgagaggccacttttgcatacatggtcttgcgcataggatttgaaaaagcgtctgtgatcagtctcaagtactgcgcacagacgctaatcatgacttcaattgactttatttaactttcgccaaaaccgcttttgcaacggttgcgacataatgcggctggccctctgtggtcgggtgcgttttgtccgctacaaaccaatcatcatggccttctgacgccttgtgccaatcaacaatgtgcagatttcgataacgatgactcattgaaacaagatcgcgattaacttcatctgtccaagtcgtatctgcatggacattaatccaatatacctgccgcttgctgccgagagtattcataattgacgcgaactcagcatcggtaaatgtgccattgcttcccaagccgataatcaccgtgtcagcaagcttgcctgaagccgctaatgatttgaacaaatccggtgcttcataaatttgtcgactcacaccagcatcaaaataaatcttcgggaaaagttccttgtataaatattcgctacccagcatgaccgaatcacccactgctgtcacatccagttgcttggccgcttgcacttgattaaaactgaggccgtcagccgcaaagtctttatagactggatctttggccttctcagaagcttgtgttgcctcccgcatctttttagccgaagctcgcgagcgaaccgctgctttagagcttgaagcagaagcggccgtcgcctttgcttgtgcctgttgatgaacaccaaaccaaataccgccgcccaataacacaacagccaagatggcaataccccaaatgagtccctttttcgattttgtttcctgtctatgcatgccgcaccccttcaaacaattaagttaccgtatgatgatatcatagaaagtagcatgagtgcgcgagcgatatatgtaaagcgtggtggttagttcagtgctacccgaagaaatgttgatgacaaacgtctgtcacgaatcagttttgacctcttcacgctgagttaatggcggcatgtcacttgaatgaagctacacattgaacaaaaaaatccttccagttaataactggaaggactaacgtgttcaacgagtgaggttctacgaagaatcactcatgaaaagatgccggctgcaggagtcgaacctgtgaccctcggtttacgataccgatgctctaccaactgagctaagccggcatactgacccgtacgggatttgaacccatgttaccgccgtgaaagggcggtgtcttaaccacttgaccaacgggccattgctgaacaacaaataagattatacaggagcactatcgcactgtaaagcattttttgatggtaaatgagatcattggcagaatcattttctaagttaaaatgattgtccatctactttttgtaagtgtatcatgaaaaagaaacgaatcgtcatgaaaggatgttgttttagatgaagattgcgattattggtgccacaggacatgcaggttcggctatttttaaggaggccctcaaacgaggccatgaagtgaccggttatgttcgccatccagataaaagtgttggaatcttgccaccggatgcagatctgattcaacaagatgcgttcacgttgacgcgcgagcagttgacgggttatgacgctgttattgatgcttttgcgacaactgttgagcaagcttatctccacattgatctggccgaccacttaattcatgagttacgcaacactgataagccacgtgtgatttttattctcggcgcaggcagtctaaagaatggcgaccagacattgtatgatacactaaaaaaagatccacacgctgctgcttttattaatacaccattgaatcaatttcgggaactgcagttgttacggtggaccgataatgtaaactggcttggtatttcgccaagcgctaactttcagcctggaccagctacagcctacgtacgtggtaaagacgagctgttgaaagatgatagcggcaaatctgtcttaaatagcgacacacttgccgttgccttgctagatgagctcgaaaacccgaccatcaaacaagcacgcttcacagctcgcaatgattaaccgcaacattttctggacatcacagaggaagggacattttggcacaagtaaaattaaccattcattatgttgatgagaccggcaagtcgcttggacctgagaaccatttaacgaacgcggtgggtcagcgttttcggctaacggcaccaactctgattggctataactttcagaaggctgttctaccagatggcagtgaggttggcgatcctacagtggtcggagtcatgaccaaagatgaacaacaactgatctttatttacagcgcaacagcctctttaacgtcacagccgacaccagcaacattggtgattaaatatgtggatgaacatcaacaagacttacgtgatgtgcaggtcttgcacacaaagacaggtcatcagtttgaactaacagcaccttttttccctggctatcagtaccaccatgcattactgccaggtggcatggtgatgtcagaccagacagtatcgggccgattgattcgcgcacataacgaactcattttctcgtatcgcgttcactcacaaaatcaccccaacaagatttaagatcaaaagccatttcttcgggagtggcttttcttttacataaaagcgcctcttaccttttcacacattcgaggcgcattcttattaaaaaaacctgcaacacaacattcagctttcgaatgattgtgttgcagattaatcgatgctctgagtcattgtcctgacaagaaactagttagtggctgttgaactaggccgccatatcttcgacccttgtagtaaatttatagcgaatttgataggcctcaccctcgaatttagccaaaattaaaattggtatagcaaatacccttaacagggtcagcacattgctcaagacgatggccgcgtcaatcttgacggccagtgattcagctgtccgagtgttcaccaagtcaagccccagcgtgcccttcataaaagcaaaccggcgttcaatggtacctcttcgattctcggcatcagtatcctcacgccgtttcgctgcatcaacgtgttttggatgccggccaagcttcggaccgcagattcggatacccaaatccttacacagctttaggttctcccgattacggtacagcgtatcggccagtacttcatccggataatgtccatgaaggtcgtaatagtggtctaaagtttccgcgaagtcttggccctcagagaatgcggtgaaatcaaaacgttcaatgtcgactacgccttcacttaacgaacagtcaatcttcgccccaaattcaactttagcattggccttaccacgttgaattgggcgaatgtacggctgttggagactaacaattcggtcttcaacgtggtgagtcttgtgggtatacatgtaccattgctggtcaaatagaattcgaatcacgcctaagcgaatcgcttgttcatctggtagagtcgcaccctgatcgatgaattcgttgatgtaccgcaaatcacggcgcacatattgaagttgggccttgacctgtttatgaaagccaccacgctgttgctttggatgtcgtgaaaatgaggtccaacaatgcttcgcctcgcgtttgtacatgcgtgggtttggcacaccaagttggtgtgccatatcgatcgccatcgcctcaagattcagccttgcttggttgaggaggacggtgtcttgaggatacttgattttgactggcactgcggttgcgtccgtgatgacggtgtccactttgaatgggaccaacgcttcgatcttggcgcgtactgtatcattcatgatattcgtaatcagctcggagatatcggcaattcgtttgcgaaagtgtgccaggctggaataattgaacggctcaaccgctttgtattcggacaacccgatgaaatattgaagtgcgggtgtatcacgaattgccgcaaccaccccacgatcagttaaacccatccgttgttggatcaggattgccccatagagtaaacgaaatggttttgccgcacgtcccgcatttttggtgaactccaattggtatgcctcatcgagagctttccagggcatgacctccgccaactggatccactcattgttagagctaagtggggtacttaaaccggcaccaaaggattcaaatgacaattgaagcgggctgtgacgatagaccatacgataacctccgagtaggttcccaaaaaatgcaaggaaaatgcaggaaaacagctaattccaatggatttattataccgcaataatgcatatattagcttaactgcctgaattatagaatttttaagcagccactagttaaggcgcttgttccaccctgttgttgcagcgttttagcatcttgataagcctgatagtaatcgcctgatgcaatcgcttggcgaattggcgttacagaactctcctgaaaaagcgccgcagcagccatttctgcttgactatgattaacaccagatgccttttgtaaaagtgaagcagcctgatcttgatccttagccgcagccataatcgtactcattttggttgctttcaacgtatcggcagcccgttggatagctgcatcggttgtcgcatcaccagtcttttgagctgtaatgtcggaaacgagacgagctttaactgcagaatcaacaggcgtgtcattacccgtcacattacgaaccgtgttattcagttgagggaaaaagaaaacccctgcgataatgagcaagatcaacacacccatgataattgaaaagatcttaagtccacgatgggcgtgctttttattttgttggcgtaattgtaatcgattgtccatgtctgtcacttctttcatttgtgatggctggtacatattatgagagtgatcgtacagcgggtcaagttaaaccagttattcatgactgatccagcctgttcttaatccttgtttaaagacctgcaaataatattaaaaaaagacatcctttgcaggatgtctcatgagctccggttgtcaggctcgaactgacgacaacctgattaacagtcaggtgctctaccaactgagctaaaccggaataaaaaaagcgtggcagcttcctaccctcgcaggcagtttcccaccaactactctcggcgtgaagaagcttaacttctgtgttcggcatgggaacaggtgtatccttcttgctatcgccaccacacttatgagaactttgcgctctcaaaactggctatcattgtttaattgctgccttgaacctaacgtacttgtcatcgaaacgcgctcactggcgcagtgatctttgtgtaaggaccttggccgccatggcaaaaaccgccatctcgtccaagcccgcttacacgccgatcactaaccgcgccacttcgcgctcttacttggttaagtcctcgaccgattagtactggtccgctccatgcatcgctgcacttccacttccagcctatctacctgatcatctctcaggggtcttacttccatataggaatgggaaatctcatctcgaggggggcttcacacttagatgctttcagcgtttatccctgccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacttgtcagtctcgcagtcaagctcccttatacctttacactctgcgaatgatttccaaccattctgagggaacctttgggcgcctccgttacattttaggaggcgaccgccccagtcaaactgcctacctgacactgtctcccgccacgattagtggcgcgggttagagtgttcatacagctagggtagtatcccaccaacgcctccatcgaaactagcgttccgatctctacggctcctacctatcctgtacaagcggtacaaacactcaatatcaagctacagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactataatttcgctccccatcacagcttgtccttaagactgcaagcatttcactcgctgtcagacttgctgcttgggcgcacatttccagccgtgcgctttccttagcctcctgcgtccctccatcgtttaaacaaaataaactagtgcaggaatctcaacctgcttgtcatcgactacgcctctcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcacccttacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcgatggtattcggagtttatctgaattcagtaacccttgatgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctgcttactcattcgccctgttcagactcgctttcgctacggctccgacttttcatcttaacctcgcaagcaaacgtaactcgccggttcattctacaaaaggcacgccattacccattaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctggacggagggttcgacgtttcgcttacagggctttcaccttctgtggcgcagctttccagctgacttcgactacgtcggactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgccggccagctatgtattcactgacaagcaatacactgatgtgtactgggttcccccattcggaaatctccggatcaaagcttacttatagctccccgaagcatatcggtattagttccgtccttcatcggctcctagtgccaaggcatccaccgtgcgccctttgtaacttaacctgtactgacttgcgtcagcggttatgcgatgcgaatttctttttcagaaactcatacaaatacgctgtgttctcggcaatttaaaacaattaatacaatgatatccagttttcaaagaacaaagtagccgacttccgtcggtcattgacctttcggccaatggaggataacgggatcgaaccgatgacctcctgcttgcaaagcaggcgctctcccagctgagctaatcccccataagggttgttcaattaacaagcgtacgcttgatgggcctagatggacttgaaccatcgacctcacgcttatcaagcgtgcgctctaaccaactgagctataggcccgataggcgtgaagaggttatcctctcaaaactaaacaaagtttcgtgtgtgcaggtttccgtcagactttcagtctgtttccttagaaaggaggtgatccagccgcaggttctcctacggctaccttgttacgacttcaccctaatcatttgtcccaccttagacggctcgctccctaaaagggttacgccaccggcttcgggtgttacaaactctcatggtgtgacgggcggtgtgtacaaggcccgggaacgtattcaccgcggcgtgctgatccgcgattactagcgattccgacttcgtgtaggcgagttgcagcctacagtccgaactgagaatggctttaagagattagcttgacctcgcggtctcgcaactcgttgtaccatccattgtagcacgtgtgtagcccaggtcataaggggcatgatgatttgacgtcatccccaccttcctccggtttgtcaccggcagtcttactagagtgcccaactaaatgctggcaactagtcataagggttgcgctcgttgcgggacttaacccaacatctcacgacacgagctgacgacaaccatgcaccacctgtcattttgcccccgaaggggaaacctgatctctcaggtgatcaaaagatgtcaagacctggtaaggttcttcgcgttgcttcgaattaaaccacatgctccaccgcttgtgcgggcccccgtcaattcctttgagtttcaaccttgcggtcgtactccccaggcggaatgcttaatgcgttagctgcggcactgaagggcggaaaccctccaacacctagcattcatcgtttacggcatggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtttcccagtttccgatgcgcttcctcggttaagccgagggctttcacatcagacttaaaaaaccgcctgcgctcgctttacgcccaataaatccggataacgcttgccacctacgtattaccgcggctgctggcacgtagttagccgtggctttctggttggataccgtcacgccgacaacagttactctgccgaccattcttctccaacaacagagttttacgacccgaaagccttcttcactcacgcggcgttgctccatcagacttgcgtccattgtggaagattccctactgctgcctcccgtaggagtttgggccgtgtctcagtcccaatgtggccgatcaacctctcagttcggctacgtatcatcgccttggtgagccattacctcaccaactagctaatacgccgcgggtccatccaaaagcgatagcttacgccatctttcagccaagaaccatgcggttcttggatctatgcggtattagcatctgtttccaaatgttatcccccacttaagggcaggttacccacgtgttactcacccgtccgccactcgttccatgttgaatctcggtgcaagcaccgatcatcaacgagaactcgttcgacttgcatgtattaggcacgccgccagcgttcatcctgagccaggatcaaactctcatataaatatgagctgttcgaatagctcgatttgttgttctagcgaattgacttcgcaaatgttactttttgcctcggtaccgaagtaccaaggaccctgcacatttaaacgaaactttgttcagttttcaaaggacgaccttgtcaaaagacaactttcatatattatcactagctgttgaaatatgtcaacagctttttgaataaacatgcaatcgatatgaatctcgaaatcggttatgaatttgacaacggagaatatattatcaactttacgaacccgcgtcaacactttttaaatgaggttttgctaagaatttaaagtccgaacgtttgcattaaaaaagcagcgaatcatttgcgattcactgcataaagatgcatgaaacaattaatcttctttggtgattgcggtttgtccttgcatgtatggtacaagcacatcgggaattttcacagaaccatcagcttgctgataattttccaaaatagaagccactgttcgccctacagcaagccctgagccattgagcgtgtggacaaactgcaatttgccgtcgtcatcacgatagcgaatttgtgcacgacgcgcctgaaaatcagtgcaattgctgcaacttgagatctcacgatagcgatcttgcgctggcatccagacttccagatcattcgtcttcgcactggtgaagctagcgtcattacttgccagcgtgatgacatgataaggcaatccgagcttttgcaaaagatcttcggcatcgtgaatcaagttttgaagttgttcccaagaatcttcaggcttgcagaacttgaccatttcgaccttattgaattgatgcatccggatcaagccgcgagtatcgcgaccggcactaccagcttcagaacgaaaagccggtgtaagtgcggtgaaattaactggaagtttttcagcatcaataatgtcattccggtaatagttgaccagaggcacctctgctgttggaatcagagtcagtggttcaccatcattcgtgatcgtataggtcgcatcagtaaactttggaaattgaccagtaccgaacatagaatcattgttaacgaggtatgggggaatgatttcttcatacccttctttttggtgctcatccaagaagaagttgtagacggcgcgttcaagacgtgcaccagcacccttatagtaaacaaatctgctaccggcaaccttcgccgcgcgttcaaaatccagaatgcctaatttttcaccaatatcccagtgatgctttggttcaaaatcaaacgttggcatgtttccccatttgtattcttcacgggaatcgtcttcatttaacgacattggcacgtcatcagccggaaagtttggcaatcggacgagaatataggttactttttcatttagctgggcgagttctttgtctaaagccgcaatcttttggcctacttcccgcatggccttaatttgatcgtcagcattttctttgttccgtttcataaccgcaatttggcctgaaacatcattgcgcttggctttaagctcttcagtttgaacggtcacctgacgccggcgcgtatccaaagctaataattcatcaatctcttcatctttaatcgcacgtgcagctaacttttccttggcccattccggtttttgccggatcagttttagatctaacatggtttgtcctcctcatatggtcatgatgcgtctgaaatctcagtgcacacaaaaagccttccatctcgttgggacgaaaggccattccgcggtaccacccaagtttgacgcctatgcgccaccctcaataactgataacggtcagtggccgtgcagttcatcactacccactaaggcgctggaatatggatggctaacagctttcaccaaccgctgtctctcttgatcatccaatagacgcttcagacgtgtttgctattcattcttaaaattaccgcatttagcactgattaacaagcgcccacactgtttttattcaaaaataatgggagccagtcctcttggcccaaatgcaagcagctatttgtcttttaataaatgaaccgggcatcttctaaaacttttttatcccaaagttcacggagtaaggcatacagttggccgtaatggtcattgctaacattgatatgccatgggaatatctgtgccttgccggctacttttttgactggcgcaaccgaagtcgtgatgaccaaatcggcatctttcagattagcattgggcgatgctaattcgacaaatgggatagcgtgcaaaaacgctagcaagtcaatatagccggtaatcgtttgttcaacaactggcgcaaccacaattttctttggcggctgaaattggatgagtagttggtgcaagttgcgatacagcgcttcggccaaaacatcaatgtacccgtcaaacgattcgagatgttcttcatccactactttttcaagcgtggctttgatctgagcatagaaagccggatcatctttggtctgctgcatgttggaactgaactcagcgagtaaagttgttgtgaagtcttttttgaacaccagcacgctgacggtgacactcagcatattggctaacaacagattatacgtctcttctggcaactgcagatgtagcttaaagttatatgggaaacacgcaaagaaggcttgaatcaactgataaatttcgggattatagcggttgtaccgttcgatcacacgtcgctcaagcgggccatcactgacaatatacagcggcgcaaaattaaacagaaaatagagcgcatcgctttccccttgttgctgctgctcagataagccatctaaaactggatgtccgtcagtcagcgcttcagcaattggtgaaaacagatttggcattggataccgtaaaatctgtgaatccggatcatgcgtcaacacctgccctgtcaaaatgcgttgatgtgccaccgcaatgtaatagagcaacaattcacgtgtaacgacattcacatcgccgcccttaaaggctttaagaacggcatcaagaatttcgctggcacgctcatgcgtcatattttcaaatggccaatccgcgccattcgttgctaaccaatatgttaaccccaaaaaaattcggatatttaattctgacccaataaacgacaatgtctcatatgaaaattgaaccccactggttttggcgtaaccgcgaataggtttcagatgtcgcaaaatggtggctttggaactatcggacgccattaaaaagtcatcaaagttttgatagcgcttatataaaactgcgtccaaaaaacgatatgggttcgactttttcaccagatcatagcgaaattcatcaattggaatggcaaacaacattttagtggacgcatgcttgcgacccagtatctcctccagagagttaaccaacccagtgtaggtattatagacactcccatagttacgattagtaatcgccgcaatttgttttaaattcacatcgccgacaaccgaataatgtgcgtgatcaccagccaactgcgttctcaccggcgtctgcgcaattcgtgccgagataatggcgtgaaacaaattgagcttttcagcgtcggacatcgacaaaaagatgtcgtgattggcttccatggactccccacccctaaaatacgattttgtgtcttttattatacgtcatactttatcaagacgcaggtattcacccctgttacgagtacaagtcgggtctaaaaactataccaaattgttattgttcatttactcggctttagaaaatagcgggtttccctaaagttcaatgtttcactaacaaactgtcatcatttttactttttttgttataattgacgtaggtaggggtgaattgcttttagataagggggtgtaccatgctgtatgaacaaacttttttagatcgcgctgatctgcagaagttccaaatgttcgcagcgatcaaagataccaatgtgcaaacatacacgatcaataccctcagtcagcacctagacctttcctatcagcaagggtataacatcttgcaggaacttttccgcgacttgacagttttaacaaaacatccagaaaaaatgaaacggaaacaaatcagtcttctggtcgatatcgatattacagtggacgattatcatctgtatttgttgcagcacgctatcgcgttccaatttgtcgattacattgtgcaagctaatcacccgtccacagacaagttctgtcgtgcccattatatcagccgttccacgttggttcgcaagacgtctgctctccgtaatcttcttaaacggtatcagcttaagttgtcctttagcgacttaggctttgccggtcaggaaagccgcatcagattgttcttgttcgccttctattggattggctaccacggcgtcgattggccattcaaagttttagatgaacaaaaaattgttcaggaatacaccgccttacccagtgccaaaaagaatccagtcgatattcttgaagaagtattgttttgggccatcagccgcgtacgcataagtggcaaccatttcgttgacggcgcggcgccatttgacaaaattttcgatgagtattcaccttttcaatatccggtttacacgaaagaaatgtttcctgcttacgacacacggtttatgaaaagcgaaaacgacttcttctactttcagcaaaatcgcaccattacatttttaccaactgacgccacgagtgatgcttttatccgctacctaagtgacaaaaaaaccgtgacgacagatttcactaagcgactcttggcttttttgaatgctcatgttcgacctgacagtgatttcgatgtttatcacgaacacgagctagttctgaatctagctcggatcgcgttgaacaatgagtttctgggcggcgatttcatgcacatcgtggattactatcaacctgaagggctgccatacacagagactaagctgtaccataccttgcaaacgttcatcgctggtttgccagacacccctgcctaccgtcgttttcttggtaaaaatgcaggatttttgcgcattattcattatcttttggctccttatttgcgatacttctcagaaactccagttgtgcaagtgaagctggtttacctaggacatgatctcctcaatcgccgtttggtaaactttctggacgatcttagtgtcgttgatttgttgccagatgatgcgccttgtcaggaagctgacctggtgattaccagtgtcgacaacgaagccgccattagagcagcagcaccatcggatttcaaaggcgaggttgccacttggattattgatgatgacgacagtggtattttccaactttatatgttgattcgccgcctttatctcggcaaaacagcttcagcacgctcatcagaaactggtacttttaagtggtgatagcatcacctaaaaaggcagttcccactcagttcaatgtgtggaaactgcctttttgcatcgttaatttcggtgatctcggtgagcggacagatcaacttggtctaacggaatcatttttgtccgatgcttcactttgtaccagacgaataagacaataaaaagcgggattgacatgtaggaaaccagtaatcgaccccaggcaaaattttgaactgcctgcaaatcctgaccaacgatgacaatgagactcataataatcgccagaattgggccaaccggaaaccattttgcatgatacttgagttcactcagatcgtgtccttgcttcacgaaagcgcgccgaaagcgaagatgtgagacagcaatgcctaaccatgcaagaaatccagtcagaccagaagctgcaaccagtagttgatagacatgcggtcccataatgctggttaaaaaggtgaaagcaccaaccaaggttgttaacagcagtgctgcaactggaatcccccggttattcgttttctggaaaacgcgcggcgcaaaaccggaaccacccattgcccacaacatgcgggtcgaggcatacatccctgagttagccgaggacaaaaccgatgtcaaaatgaccgcgttcatgacactggccgctcctgctaacccaatgcgatcaaataccaaagtgaatggcgaaatcgcaacttgatcgacactcgcacctaataaattcgggctggtatagggaatgatggcagcaatgatcgcaatagataaaatataaaagagcaaaattcgccaaaacacctgtttaatcgctttaggaatactcgtttccggcgtggcactttctcccgcggtaatgccaatcagttcagtcccttgaaaagaaaaaccagcaacgacgaaaacggctagggtagctggcaacccaccaacaaatggcgccgctccggttgtgtaatttttcaaaccaatcgggccattgccgcccatgatcccaacgatggtcaatagaccaacaacgagaaagaccagcactgtgacaattttgactaatgaaagccaatactcagtttcaccaaaggacttaacagaaataatgttgatgacaaaaatcaacgctaagaaccccattgaaatcagccatccaggcacatctggcagccaaaaatgcatcacgattgcggtggtggacacatcaacggccaccgtgattgcccaattgaaccaataattccaaccaagtgcgaacccaaatgccggatcaacaaatcggctagcatactcggagaacgaccccgaaacgggaacataggtagccatttcaccgagactggtcattaggaaaaagaccatcaacccaatgccgacatacgccgcaatggccccgcctggtccagcggtggcaatcgcactcccactggcaacaaagagaccagtgccaatgctgccgcctaaggcaatcatggagagatggcgagttttgagttcacgtttgacttgatttgattctgactgtgccaatagtttgctccttttgaagtttttgataggttgagaatgcgaggctcgaggagcgaggttagctttctataacgcacgaaccagcccagaaacctacacataaggaccttggacgcaatggtcaaaacccggccatcacgtccaaggccgcttatgctccggtttctaaccgggctggttcgcgctcaacaaaaaaagccaacgggcgagaatcaacccatcagcttatcatttttctaacaatgactaaacgtgatccgattcattagcgccccgcgatgttcgcgacagtccagcggatgttgtccaactggcccaatgtcggatttctgaacaaatccggcatttcggcatccgccccttttgcaaccgcgcatctggcgttcaggccattgcagttgggattcatgacagatgcaacctctaatcgttattggtttacacgttaacatgttcggccttcaacagcaactgcctctcacaaggctttaactcaattctcagccttgcgaatatcggctaccagtgttgccgtgtcaaatttttgctttaaaaaagcatcgttggttgtcggcagatgtagctggaagtcactaaacttttgcagaaacaattcgccactgtcgagttcgaagccaagaatatggccacccatgtgatgatcagcgtcaagaaaatgcaagtggaaccccggtgacaccgcacccgcatagagatcaggcgaatagtacccaatcagtgtgcccttgatattctcagcgttgaattctttttgacctgaagctgtttcagtaagcgttggatacggtggctgttgtggcaacaccgcgcgtgtatgcatctgcgtaaaccgcccctcaacgcgtactgcagcaaaaagattggccgtttgaaggcgttccaaaaccgttttttgaaagcctgacaaatcaagtccttgtagtttgcctacagatttatcagcttgataatgcacgtttgcaaacggtacttcttcttctgacccgacttcgcgaacagcgccttgtgcattgacttgataaactttgctatcaatgatcacaagttcgccatctagccccgtcaaagtgccaataccagtattgccatgctgcagcagttcttcaatcttttgcgtaccagcaaacaatccgggtacaagcattgccaatgtgccatgttgatataaccgatcagtattcacagatggtctcctcctattacgcgatcgccaagcgcaatgctgacgaatgaacaaaagcttagtaaatttggtcaggaagcatcgccgcgccaagctccgcgttatcagaataatcaactggaatatcaactaaaactgggcctggtgtagcaaacgcctcatccaaaacctgccctaattcacttggtttattgacccgcagtccctttgctccaaatgcttctgcatacttcacaaagtcaaccggaccaaagtcaacgccagctgcacgaccgtacttcatttcctcttgaaattttaccatatcataatggccatcattccaaataatatgcactaagtctgcatgcaggcgcactgctgtttctaattcctgtccggaaaagagaaaaccgccatcgccagaaactgagaccgcctttttccctgggcgaaccaacgttgcagcaatcgcccatggtaaggcgacaccgagcgtttgcatcccattggaaaacagcaaatgtcgtggttcataacttctgaagtgccgggccatccaaatataatgactcccaacgtcaacagcaacggtcatttcatccgtgacccgctcctgtaaggcagcaacaatgctgagcggatgaagcactttttgatcagcaattgccggtggtacatcgctatcctgcagttttgcctgaaggtcttctaaataacgcttgctgccaggtgcaacttggtagccacgtaacaatggcaccaaaatatctaacgtttgcgaaatatcaccaatgagttcagtttccggctggaagttatgatcaatctcagctggaacatcatcaatgacaatgatgcgcgccttgccatccgcattccagttacgtggttcatattcaacgggatcgtacccaatagcaatgaccaaatcactatgttgtaacaacatgtcacctggttgattgcggaacaggccaacccggccgaaaaagttgtcaatctgacggtgagaaatgatgccagcaccttggaaagtttccacaacaggtagttccgttactgaaagtaattcgcgaatctctgctgttacatcacttgacgatgcccgcattcctaacaacaacactggcaatgacgcttccttgatggcgtgcgccagatacgtcatatcactggggctagccggtccaagttttggtgcgaccagtggttttatcggttccgagttgactggcgaatctgtgacatcttgcggaatagaaacaaaacttgcaccttgcttgccagattcagccgcttgatacgcgttcgcaattatttcactcacgttatcggggtcctgaacttcagccgcatatttggtgatcggggcaaaaagatcggcgttacgcatgctttgatgagaacttcgcagcaaatcagcgcgtttgacctgaccggataaagccaaaaccggatcaccttcagccgttgcggttaccaagccggttgccaagtttgatgctcccggtcctgaagttgtcagaacaacccctggtttgccggtcaaacgaccgatgccagcggccataaacgccgcattttgttcatgtcgcgcaacgattagctgcgggctcttttctgatttaggatgctccagactttcaaaaacccggtcaattttggctccaggaatcccaaaaacatagtcaatgccgtgattcgttaaactttcgacgatcaaatccgcgccatagcgcttctcttctgccattttgccacttcctcctgattgatgtgtttcatattacgcttattgtgtttcgattcaaccctatttttattgaaaaacagcaattaaacagcaaattgctgttacattatttccataaatctgtttcattccattgacaatgcggcgtacttttcttacgaatggtttgctaacgccatcatgccacaaaagttgatcacgacccaatagtttgcctagtcttcactgagccgcaacacatttagttaaaaaaaacaccgcctctaaaagacgatgttcattaaatacactgcataagctggataaacagatcattgcatcttacgactgattttgccaataccagtctgcggatcagtcagtttaattgtaaaaccaaatttagtgaaaatatgccgcagttttgtcaaattaaccttgtcaaacgaactaatcgtaccgtcgacttgggcaatgtcagctttcgttgccaaattaatgaaagctttcaaagcaagctgggccaagcccatattttcaaaatcgtagaaagcgagccggctctccgacccaagcgtctccaagacagtgatgtgcatgccgttatcccaacgattggtttcaaacaaaagttgtgactgataatccgctttggaatggccatatttatcaacattttcaaaaggcgtataaacgtaaattgaatttgttttttgcttttgctcatcgaatttaaaatcagtaaacacaatatattggcttacctttttttgggctgcgtcctgcggttgattcatgctagacagcacggttagccgtggatctgcctcgatcgctgcaagccgcttgttatacgcttgctgatactctgtttgcacagtcatcttgaaacctccagactattactcgttttcattataacatttttcaaaccgatgcctatctaaaagaaaaaaaccgggatgaattcacccggctttcataaaatagctatagtaatttctcatttttcaaactgattggggagtaatcggtagtatcgctcattgcgcggttgatcaggtgtcaacccacgagggagcggcacttcgaactgaaaatcaaagccaagacgctgtaacaagttgatggaagcgatattttctggaaagacacctgcccagacggcttgaataccgttatgaaattgatcatcgatcaccagtcgcaagccttcggtcatgaaaccacgatgccaaaaatggggatgcaggatatagccgatttcccgcgtcatatcatccccggtcaacggcgataaatcacgcggatagacgccaatgttgccgacaacatgctgccgatacaccaatgccaaatcctgcttttcacgggcaaatcgtcgaatgtgttctaaggcggctgcttgtgactttaagggggtcatgccggctggtaatgtggcttgttttaaatgtgcataggcgaaataatcctcaacgtcagtcaattcaaatggccggacagcgattcgcgatcctttcagcatcagcagctcctttcagactaacggtctcatgaattggaaagatttttctactttgtgagatcgtcgcagctttttttggttttttcgccatattttaaagtgacgcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctagggacgaaactatttttcttttcatattatcgagtattcgcaaccagataacaagccctagctcctttcatgatgcgtccatcacaagcttccaacgctttgtttattgaaataatcggtaaaataaagttgttatctggtaactgtccgttatcgccgactatattgaatgcagtttaagctagtgaccaacacttggactgggattttttataagaaaggaggacgcaccgaccagaaatgaaacacacatatgtcaagttgatgaaacgacttaaaacaatcgaatccgaaaactagcgaccttattcatgcttatattttcgccagatgtagtgatcttcattaaaatggctgcactggtgtgtcggttcatcacgatcaacctgagcaattcaacctgcagatagtcactgacaactatctgctacataaaagttggataaaaacatccaccaataccgcttcgacgacggtattagcggtctgtggagggtttatcatgaaaagaatcgctttgtttgcactaatggtgctagtgatcagtccatttctcattgcagcagggcaaaagactacggcaacaacaccagagtttgctgttacacctgtgctgccaagtaatcaaaaacaggcagacgcaggctattttgacttgcaggtcgatcctggccagcaagaagatttgcaacttcgcatcagcaacctatctgatcaggtgcaaacttatacaattgccgtgaaccctgcttatactaccgacagcggtgccatcgcctttgatcgcgctatgccgcctttgaaccaagatgcacgccgtttgaatacgctcattagcgggccggaaaaagtcagtgttccagccaaaacagagcgattggtcacttatacgttaaaagcaccgagccagcattttattggcgttatttctggcggtttctatgtgtctcctgaaaatgactccagcaccaacaagtcggcaagcggcgttagcttcacgaatcgttttgctatcgggatcaccactattttgcgccaagatttcaagacgcctaatccgccactactggcaatgacaaaagcaggcattggtacgattaatcactatgccgccgtccaagcaaccatcagcaatccttctggcaatcagttcggtgacatcacgagtgactatgccttaagcaaaacaggaacaaaaaaggccttgataaccggtcattttgtggggcaagccgtcgctccgcactcatttttcacccaaagcatcctgctcaatgaccgcaaactcatggctggtgactattccctcaaatggacagctaaatcaggcgacttttcttggacaaagacacttgcctttcactatagcggtcatttaccaaaaaacaccctacaacctgttgtcaacaaaccaaagacaaaagcacctgacaatccacaactgccttggatcattagcggtatcgccattgcgcttctcctcatcttgaccggtacatggggctggagcacttggcatcggcggcataaccagtagaaaaacgtgctgcctgcgcgcgattggcttatgataaagggagagcgtgaactgatgcggttagaaaccggaacataagtgggctgggacgcgatgactgcactttggtcattgtggccaaggtccttatgaggaggtttctgcgccagtgatcgcgtttaaaaagagcgtgaattggcgcggttagaaaccggcatataagtggcctcaaatgcaatgatgcgccatggtcattgtgctcgaggtccttgtgagacggtttaggcgtcagtgagcacgtttaaaggaggacttcccatgtcaaacaatcgcatgctcggaaatgagtttcaaacagcatatgaaagtgctggcggaacggatattttaaaatttttagcgaatgtcaagcaggcattccagtgcattacggatttaactgcacgaatcactggtatgccagattcggttaaaagtgagtctgtctctcagttattagttcaacaattggatcagacaaccttcgccgaaagtgccgtgcgtcaatgggaagacgatttgcatcgctttgctgcttatctcacaccactagaaccacctatcgcaattcttgatagttgggatacattaaatgactttttggaagcgaatcaagcattattgagctcattgcaaaacgtgcctctattgacccaagaaactcaagaagtcaaaacaacatcgcagttgttcgtctatccagcagaacccctattccaagtcgttcaggccgacactggcgaaagcgactcaattgatttggccggtttggcagatgctgatcctgaaggtgtcgctgaaattgcgcagaatcacggtgttacaccttttgcagcgtttaatgcccagccttgattttaggctgtcaatcctgtatgcttgacaggttaaattatgaaaaagtgaggtgctaaaacatgcggaataacatcatcttaggcaacaatgaaaccggcgaacggatctatttgacttccaagaacaagcggaatacacctgatcgtttgcaactcaagaagtattcaccgaagctgcgcaagcgcgtggttttcaccgaagttaagtaattattcaatgacttcatcagtctatatcgcctcctatcagtgtttatcattggtgggacgcgatatttttttgcctttttatgactgctgatgagccaccactggcacaacattattgttaacatgagcaagttattaggctggccattcttcaacatgctaaagttacttatagtaagtgcgtgacgctgtcctcaaacaagaaaggttgattcctatgacatttgttttgccagatttaccttttgactatgcagctcttgaaccttacattgacgcaacaacgatgcaccttcaccatgacaagcatcatcagacatacattgataaacttaatgccagtttagatggtgtccctcaggcggccggcaaatccattgagcaactattgacagggcttgatgcgctgccagaaagcgtgcgcgtttccgtccggaacaatggcggcggacactataatcactcattgttttggacgatgctgagtcctgaaagcaccatcaaaccggacggccaattattagcagatcttgaaagtaccttcgattcatttgacaacttcaaagccgaattcagtcaagcagctttatctgtttttggatcaggttgggcctggcttgtcaaagacaatgcgaccttaaaaattgtgacgacagcaaatcaagattcaccaatcacgtatcatcagtacccgctgctaggcttggatgtctgggagcacgcgtattacttgcattatcaaaatcgccgaccagaatatgtggacgccttcttcaaggtcatcaactggcagacggttgaaaatcgcctgatgcatcctgatacaaatgcctgacaatatttggtcactaactttactaaaagccgaagtgcaaacacattttgcacttcggctttttttcatgtcttcgcctgaatctactgcacgtcatactaggtcagattgttggctcaatttggggtgcttctgtcagcagttggttaaacaaagccggcaccgacaattcagccgtaatccgcttttccgaaaaaggatccataaaattcaaccgcgtcgcctgcaaggcttgatacggtattcgcgcatctggctgaccataaaggtgatcgccaattaatggatgacctaaacttgcaaaatgaacgcgaatttgatgtgtccgaccggtcagcaactggacatcaaccaaagtattggttttttcttttaaaacccggtattttgtcagcgccgtctggccatcagctgccacaattcggtgaatgccatccgccgctaatttcagaggtgcatcaatttcaccttttggggatggcaatttaccgctgacaaccgccaagtaatgcttcgtcagtgtgcgttgatgtgcttgatcaaaccggccttgtgcgtatggatgttttgcagccagcaccagtccgacagtatcgcgatcaagtcgagtcatgatggctggttgtggtgcgtcaattttttgctcaaccaaatagcccgcaatacgattcaataaactcgaattcggtgtgtggggtccgggaacgcttgtcaatccagctggttttgagacaattagccaattagcatcttcataaatgacttctaaaggcgcaaactctggcgtcagcgttttgctagtcggaatttcaaagcggataatctggccagcttcaaccggaccattgtcagatgcttgcccatcaacccagatcaaatgatccactagcatttttttgaacaagcgatgactgacgccttgctctgctagccagcgtttgaccgttgtcgaccgtgtcacctttgtcgtaaatgaatatcgcatactttttttcctttcaccatccttctcccgtacttaaaaccgaacgaatcggaatccatatttgcatttaaacgggttttgggactatggttagactatggttaatgtacaagaataaggaggaacaggcaaatatgcaagtggaaaaagacgtgatctacgatagcgcctataatttagccgccgatctctatgtacctgacgaagccaatggcggtgccatcgtgtatgcacacggcggtggctggtttcgcggcgataaggaaaatgaaagcgatttaggtaaatattttgccgatgccggctatctatttgcgattccgaactttcgcttagcccctaaatatttatatccaacagcacaaaacgatttcgatcatttcatcaattggttacttgcttccccttatgattttgatcgtgagcgtttgggacttttgggggcaagttcaggcggcaccatggttctgcaaaacagtttagcttccggctatccgctcgttgcatggtcccctgttgttgattttgccaactgggttcaaaaaaatcaaatggtaaaggcttctgtggatgggaaaaaagaacttggtcttaccgagatccacgaaattcatgattcattttacaagtatttcgtacagacttaccttggcggcttagacccgcgtttgttgaccgcggtcaatcccaccaaccatttaaccgatcaattaggtccggcattgttgttcaattcagctgatgaattgatgccactgccaagtgccttgcactttttacaacaagctgccatgtttggtcgcgatatcggactgcatgttgtgcccggaaccggtcatgcccgcgactacacaagttttgccttgccagaaaccaagcgcttttttgatcatcacttgtttacgacggttgaagacaaaacgttgaacaaagcgacagactgagcttaacaacaatttcggccagtaaaatagcgttgcgatcaaccttcattccggatggtgatcgcaacgctatttttatgcgtcaattttaacaaacatcaaccgtcaccgggtgcaaaagtcggttcacggttatcttaagtaaagaacttcatgcgtgatgcagaatcaatggcgctgcgacaccgggcgcgacccattcaaggccaccactaactggcaccaaataaatggcatcagcgccgacatccgtcgggatcaagacaaaaccattgccttctggcgttaccttatagccggtttttgttgttacgccagcctgaacaacggtcagctggtctgccgtaattgtcagcgtcacgtgctcattctgccatgtgccgagataaaccggtgcagtgttgctgacatcctcagcactgaccgaaggcgttgcttgagtcgtacttgctgtcgaagctgtctcggtatgcacagtcgcaaccgtgctcgaactgctgatctcttcagaaggttgtgttgttgccgctgaggaatttgttacagcgactgtcgaagaggcggtcgcgttctcttttttaggttttactgttgcagctggttgctttttaggcgttgtgacagtgactgtttttgtatcagtcccggcatttgcctgatgctgataaagagcagcaccggaaaccccactgaaggtcaaaatcgctgttgccaacaaaaaccactttttcatgtcattcactcccaaccagacatactgtcgtcgacaggtccgtttttcttattatctctagcctatcatgctgcctaatcaaatgttacaaaacgatttcaatacaagcaaatcttaataattgcggcattctcactgtcatttttttgtaacatttaaaaatcggtggttttctcttgttgaagcaaacatatgttcgtataatcgatttgaggtgatcatcatgacttatgaagaaaaaatcggcaccgaaagattcgatgccatggtggcggattttttcgcaaatcgttactttgatcgcggcatgcgtaaatggcaaggctactatctttctgatcatacagccgctttaaagaagcaatctaaaagcgaagcgctggtttatcccccgctgccccttcaggatcaagcggtcattcgcgcaatcttgctacaagcctatgcagaaggccaaacagtcacagcccagcttaacctgcaaacacccagtggtcagatgctgccaccgattcgcggcaaggttggcggtttaactgacagtgacgtggttaatattgcggatcaaaatatggcaatcggatcaattcggcacatcgaactcatcccgtttgctgcatcaacgcatcaaaaaaatacgccagactaaggtagtcggccgtgccgccggggctcaaatttcgtgcaatcatttcggcgtttaaagcgcgcaacccattaggtagccgggacgccggtacatgtaacaacgctttggccgcatcctgaacaaaccgtaacccagctggccccccacggtgcaacacattagcatcttcaacttgtgccatcagatgaaccatcagctgcagatagcgcagatcgccgcgtgtcgtggtttgccgtaagtaaggcaggataaccgtccggatcgtcgggtagccggctaacgcctcaccacgcacgccagtcacaccatgcttcatatacaacgcctcgccatgactcaactgttttttttcactgagatcgcgaaaatcgccgctcacgccttgtgcaatttgcgccactgccggaaaaagcggcgcaaaatcatgcatgactaactgcttaagactttgcttttgcaacaaccatcccaaagcacccagtaaaaacccaaaagaaaaattagccccgcgatgcgtattcacacctactgtagctgtcatcatcgctttttcagcctttaccccgatcgtccgcaactgctggtacaactgtggtaccgttgccgccgttaatccagcatgcagatactgaccaaaataaggggccagcgcatgaatgctggcctcaaaggtggtgacgttcatatcgcgatgagcgccattggactccggatcaactaagcccggcttcggcgcaagcaaaacctctgcccgcagactcgtgaccgctgcttgggcgattgtttgttcattcaatgttctttgccttcataactttcagaatatattgcaatgagtggcccaaatgttcacgcgtgatcagtttgatttgatcatcatcgcggtttaacatcccccgataaatcagccaatgttcctgaatcgcaagattacgccgatcatccccgttaatactgatatcacgaaaatagatcaagtaattttgtaattggttgacaatcattttcagccgcaacatatggctggcatcgtaaataaaattattaaactcggtaaatttggccatgacttcaggcacccgtccagcatcattcaaccgatccgtttcttccagaagcgcacgcatctgtttaaattgagccggcgtcattagccgcattgccttacgtgttgctaaaacatctaattccttgcgaatatcaaaaatctcgtaggcatcgttgatcgaaatgcccttcacaatgacaccgataccggttttacgttcgaccagatcttcttcatctaatcgttcaagcgcataccgaatcggtgtccgactgatattgagattctcggacaaattcttttcgttaatacgctcgccgctgggtatttcccctaacaaaatcgtcttgcgaagcgcttcgtacaccgcctctttaatcggccgattctccgaaagatccagattccttttgactgctggcaccacttgattcatcggtcgttccccctcgcttcgtggcctattatagcaaaaaagccgttaacgggggtgttaacggcttaaggggaatgaagctaggaacaactggcaactagtctagcaggctcacgcaacgacggtcaacatcagatcaatcatgcgtcggctcaaaacttagcgacaccttctgctccggcacatcataaaacggatcttcgcgtcggccaagaaaatctttagcttgatctgggaacaaagcatagcttaagacatcctcttcgtcgtgcgcatattgcgcaatcgcttgacaaaactcaggcatttgcggcttgattaaatccgcgggacgttgtgtgacaaccggtgcatcaccaatgatctttttcaccatttcgggtgcaattgccactggcggccgaccataaaggccgcgcacgtaatccttaatttcatttggaatcaacttataacgctcaccgctcatgacattcatcaaactttgtgtgcctaccatctgcgacagcggtgtaaccaacggcggatagcctaagtcagctcggacacgcggcacttccttcaaaacatcgccatagagcgcttcttgtccttgatcttttagttgcgccaacaggttagacaacatcccgcctggcacctgatagatcaaggatttaggttcaacatctttcacgcgcggattcagttgaccggactcgcggaatcgatcgcgaatcggcgcaaagtaagtggcgatgtcactgaccgtgcttaaatcaacatcagtcggatagccaagatcttgcaacgcaaccagcatggattctgttgctggctgactggtgccgccagcaaatggcgaaaccgcggtatcaatgatatcagcaccggcgcgaactgcttccagataggtcatctcagccataccagcggtggcgtgcgtatgcacttccagtggcacgctgatttcctgcttaataccggtaaccagatcaaacgccttctgtggggttaaaatgcctgccatgtctttgattgcaatcgaatccgcacccatgtcagccatgtctttggctaacttgatgaagtagtcgatcgtatggaaatcactggttgtgtaacaaatagcaagttgggcatgcccgcctgcttgcttcgtcgcttcaagcgccgttcgcaagttgcgtgtgtcattcaacgcatcgaaaatacgaatgatatcaatcccgttttcaactgactttgtgacaaagtcagtgaccacatcgtcggcatagttcttgtaacctaacaagttttgcccgcgcaagagcatttgcaatttggtgtgcttgaccgccttacgaatcttgcgcaaccgttcccatggatcttcattcagataacggagacaggcatcaaaagttgccccgccccacatttccaaagatgcatagccggcagcatccatcttatcgagaatcggcaaaatatcactgatcggcatccgcgtggcaatcaggctttgttgcccgtcacgcaaaacggtttccatgaattggactttctgtttaggcatggggtgtcctccttttaaagcgcattcactgacccagaaacctgtgtgtaaggaccacaagtgcaatgcccaaagcccggccatcacatttgtgtccgcttatgttccggtttctggacgcgccagttcacgctctttttcaaacgcgctcgccagaccagaaacctgcacataaggaccacaagtgcaatggccaaagcccggccatcacacttgtgcccacttatgctccggtttctaagcggtctggctcgcgctctcttttacgattgtttccaccacttgttgtacctctggcaaaccgtgccgccgtgatcgggcacaggccttggcgtcgccgccgcaaaccagacaggcacgtggtggcaaggcaagatccgtgcgagaaacttgatacagttccgcatcgcgtaacgtgacaacatcaagatccagcaagtcacagaaccgttgctgattttcaaacgcgaccatgagccgcttgagtgacaaaggtgacagcgtggtcaaaaaataagcttccggtccagttggcaataagtcaatgtccgaagatcgaacgacctcgccaagttgctgcgtcaaggtctgcatgaccgccgaaaaaacggcttcaattcgagtaccagttttaaccggtccaggaatgcgcaaagtcacgtgcaagagcgtattggttggtgcagccaccaacaacgctcgctctttaaccacgcgagcatctttggcagccagcatttgaccaagatcaacttgtggaccatctaaaatggttaatttaaacattgtgaaccacatcgatcaaggtgccatcgcgatattcgatcaaagcgaccactttatcgccatactcgatggcttccggtgtaccagtaatttgataggccatctttttcagatcttcaattgaaaacagcggcactttcagatttttaaacatttcaatcaaatcagtccgtgctggattaatagcgacgccgacttcggtcacgacaacgtcaacactggcacccggtgtcacaacagtattgacattttcaacaatcgttgggatccgaccgcgaaccagtggcgcaatcaccatgctcattttgcaggcagcacttgtgtcactatggccaccagaagcgccacggataatgccgtcagaacccgtgatcacgttaacgttaaagttagtatcaatttccagtgccgataaaatcgcaatatctaactgattgataactgcacctttgcttaacggtgacgcgtacatattagcatcaatctcgtaatgatctgcgttctcgcctaatgaaaccgcagagggatggtcaaagtcctgcacatcgataatcttttcgacaaggccttccttcaacaattcaaccattgaattggtaatgccacccaacgcaaaactagctttgatgtcttggtccaacatcgcttgccgcagaaaacgcgcaacagccagcgaagagccgccagtaccggtctggaatgagaacccatttttgaagtaggccgatttggtaatgacctctgccgcatactccgcaatttttaattccttcgggttcttcgtgaaacgggtcgcacctttggcaatcccagttggatcgccaatcgcatcaacttgcacgacatagtcaacgtcggtttgcggaatgctgattggcgtattcggatatggcattaaactgtcagtaatggcaacaacttgatccgcatatttcgcgtcaatcatggcataacctaacgagccacaggtcgccttaccttttgtgccgttaatgttgccgcactcatcactgctaggggcaccaagaaaggcaacgtcaatatgaatatcgccacgagcaatggctcgggcccggccaccatgtgagcgaatcacaactggattcttcatgatgccgcttgaaattgctgcccccactttgtcgcgcaagccggaactggtgatgttagtcaccacaccgtttttgatgtgctcaatcaatggctcatgtacattggcaatcgaacttggcgcaattgacaggttcttgatccccattttggcaatctcagctaggaccatgttcatcacatagtccccttcacgaaaatgatggtgaaaagaaatggtcatgccgtccttcagtccagttgccacaatggcatcgtgaattgacgccacgagtttgctgtgatccggcttaaccgggttgatgtggcgggcatgttcatcataaggcttaatgttggcaaactcgccgccataaacaccgtattgatccgcatatggttctgggatctcacggttgagtgtattcttgaccatcagtctacctccattcctgatgcctttgcgagcgcgatggtatactgtgcccgttcgacaactggcttatcaaccatctgcccgttcacagaaacaacccccgcgcccttagcttcggcttctttcaagccagcaacaatctcacgtgctttttgaacttccgccaaagcaggggcaaaaaccccattaatgactggaatttgccgtggattgatgacggacttgccatcaaagccaagctgtttgattaaggcggtttcgtggcgcaaaccttcttcgttgtccacttgtgtatagaccgtatcaatcgccgcgatgccagcttctcgcgcagcatgcaggatatagttacgggcaaaagacaattcagcgccatccgtcgagcggtgggtatgttgactcgtcagataatcttcagcacccaacgcaatcccaatcatccgtgatgaagcctgtgcgatttcgcgagcattcaaaaccccttcagccgactcaattgcagccatcatgtgcgtggtgccatttttaatgccgtacttctcttcaactgctgtgatgacagcatcaacatccataatgtcttgagcagtttcagtctttggcaggcgcaccacattaatgccgccaagaaccatcgcttcaatatcttgatccccgcctgcatctaacgcattcacccgcacaactgtttccacgctactgtaatcaaaggtcttcagggctgaataaaccagcattcgcgccgtgtctttttccttcaaagaaacagcatcttcaaggtcaaacatgatcgcatcagcaccataaatcggagcatcacgtaacatgcccggattggcaccaggcacaaacatcatggttcttcttaatttatccatgcgttgatctcctcccagtcaaacgtcttattgtcagacgcacgataaacagcggcgatcgtccgcgccttgatggtacaatccaaggcgcctttgtcattcgcgtcaacggcaacattttcgatccctaacttggccaaggtggcctcaatgactgatcgaatttgatgaccaaactgtttttctacactgctttgcagttgaatggcgaccccactggtagccggtgacaaggtgatttgaatatcacttgattccagcgtaccagcagtcgcaggatgcttaatttccatgtgtcgatcgctcctttatttcttgataaacttctggataaaccaattgctgcacggttttccaatcttgttgtgccattgccgcgcgaacacgggtagcactaacaacatcgccgtcaatcatgagccgcggcacgacgatcagttcaatcgccgaaccaaatgttgccgctagttcccgattgtaaatggccgttaccggcgacagcggttcctcaccgacatagcgacgagtaatccccaatacgggtgcaattgcttgtttaaaaagcgcggcatccagccgagcttggacagcagccacatcggcatctgcccgttctttgagaaaataactcggaaaagtagtatttgagaccatatagtcattggttggcaacaccacgacgtttggccagcgagcggcaacttttctaactagcgtcaaccgctcatcagctgcgaacaaagaccgttccgctgacaagacgaaaacgtaaacgaccgggttgtttttggccgccgcctcaattaaataggcatggccacgcgtaatcggattggcattcatgacaatcgctgccgctggtttttctggccgccgctgcttttctaacgaagcaacataatcggtcaagttgggataaccgcgttcaagtaacacaacagcatcggttgctgccagttgcttgaagcccaatgacaggaaaaatttaacggtggtcggtttggtatagacaaagctatgggtcacaccatcatcgtcaagccgatccagtaatgcctgaattacctgtgccaacaagttttcatgctgggttgctggtgtaactgccacttccttgatgatgttaccggaaagcgaaccagttgccagtaacgtttctccttcaaaaataccaactgtatagtcaacctgacgatctgcagctaacccggcagtcatcagcaaggcttgccatgctgctgcttcttgcggattcaatgccagccagattcgttttaaagttgccatgttacttcgccgcttttttagctggggcaaatttcagtaataacttcgccacgatataaataatgaataaaacgatgaaaacgccgcccataccgatcagcatcaattcacccgcttgttcaacggcaactgggtcaattttcatggaagtacctccctttttaacgtgctcaccagcgcagtaacatgcgtgggtctaaacgcgatctccagcccagaaacctgcacataaggacctcaagccaaactggccaagacccagccagtttggcttgaggccacttatgctccggtttctaaccgggttggctcacgctcttatgcgccaaagaatgatagtaacagtccgccggcaatgacagagccgatttgaccggaaacattagcgccaacggcatacatcaaaacaaaattctgtggatcttcatcggttgccattttttgaatcactcggctcgacattgggaaagcggaaatgccggccgccccgatcattgggttaatcttatctttacggaaaagattcaataatttggcgaacaatacacccccgacagagtccatgatgaaggcgaataatccaaaagcaatgatcatcaacgtttgaatgttcaagaattgatcagcttgcaatttaacggaaatcgttagcccaagcagaatcgacacaatattgaccaattcgttttgcgcggtgttagacagccgatcgagcaccccacattctcgcagcaggttaccaaacatcaggaacccaactaacggtaaggaaatcggggcaataaacccggcaataatcgtgataatgattggaaacagaatttttgtcgtctttgaaacgccttctgccttataagtcatccgaatccggcgttcatgctttgtggtcactgccttgatggccattggctggatgatcggcaccaatgccatatacgaatacgcagcgactgtgatggcccctaacagatttggcgcaagttggttcgaaacgaaaatcgaagtcgggccgtctgcggcaccgatgataccaattgaagccgcttctttgatattgaaaccgaagaagacagcaacaaaaacggtggcaaagatcccgaactgtgctgctgcaccgaacagtagcatgaatgggttttgtaataacggtccaaagtcaatcatggcgccgatcccgatgaaaattagcagtgggaacagttccgtattaataccggctttgaataaaacatcaagcaccccctctgctttggtgccgccaacaacttgggtcaagacgcctgttcctggaaagttgaccagaatggcgcccaagcccatgggaactaaaagggttggttcatattcttttttgattcccagatacatcaggagcgcgccgatcagcatcatggcgatttgacctaatgtgatcgtggtgattccgtgaatgagcgcttccatgccatccctcctccttaaataatgctgatgagattgtcgccggaattgacattctggttaagtgttgcaaacacctggccgatggtacctgccttaggcgccacaatttcgttttccatcttcatggcttccagaatcatcagcggctgattttccgtgactgcatcaccgtctttaaccaaaatcttggtgaccgtgcctggcatcggtgcagtgacaacttcaccttccccagtcggcgcaaccggagctgcaggtgctggcgcagctggtgcggccggtgccggtgtcggcgttgccgctggcgtagctggtgcggccggcgcaggctgggcggctggcgcaccgccaatttcttccatttcgaccaaataggttttcccatcaatcgtgatcttgaattttctcaacatcttcttcattccacctttttcttgattgacttgaccacataattggcatggccatcaccagccgcaatggcgctggcgatcaagccgacgcgttttgcttcaggattctcgacatacagatgcttcagcactaactgcgcatcaggagctgtatcggctgtgactgctgcggcaatcagactgacggtcagttctgatgccggatcaacagctaaatagtttggaacatcaatccaatcatcatcaaccggcgcggccggtgctgacatttggggtggcacttgttcttttgtagacggtgtttgctttcgtcgccgcagccaattaaacatctggacacctcctcgcaatattttcttgttgataagttatatagtacggggaaaagccaatcatgattggcttttcggtgtatttttcagttaggacgttatttttgcggcaggtagaatggcacgtgaccgaataacatcaccgtgacaacgaagatagcgaacacacctaacgcatatttaccagcttcgcgctgccatttacccatgtccaagccggtcaaccggagtaacagatagatgaaggcaactaatggtgacagtaagtggaacgcctgacccatcaaggaagccagcgccatctgcatgttggtgaacccatatgctcgaccagctgtagccagaaccggcatcactccgaagtagaagccgtcgttactcaggaagaaggtccctggtgctgaaatcaaggcaatgacaaggccccagaagccagccaatgaatcaggaataatggaagtgaaactcttggccagcgcttcggccatcccagtaccttggaacagacccatgaagacaccagcagcgaaaacaagaataacaacttggacagcatcgccaccgttggcaccgatccgcttgctttggtcgcccagtttcggatagttgaccattaaagcgatacaggttccaactaagaacaacaacaatggtggcattgcaatggctttaatgaaggaacttgcaaccaaccaagcaatcaagacgattgtcaaaataccattgaaaaggaataagttcgggcgccgaatttcagaaacttctgggtcgacaacggaagtcatttcatcgatttcagcatccgttaactctcggacacccaaccgtttccgttctgctcggcccatgcgcggtgcaacgtagaaaacaacatacgctaaggcaagaatcatacctggcaacagataggtcagaatatcagcgtcaactttcaacacggccattgctcgggcagttgggccgccccaaggcagtaagttcatgatggtgttctgcaaaataatcaaaacacctaagttcatcatgttcatgttgagctttttatagattggaataaatgcggaacagcagatcaaagttgtcgtcgtaccgtccccgttcagtgacacggccatcgcaacaatcgcggttgccatcaagactttcatcggatcgcccttcgcgattttgatcatccgggcagtgattggatcaaacaaaccagcgtctaacataattgagaagtacagaattgcgaataagagcatgatccccgtgttggcagttgttgtgagtcccttcaacacgaaatcgccgatcgtacctttattagccaccccggccaccatcgcaataatcgcaaacagcaggggaatcataaccaaggaagtaaatggtgaaagtttcttagtcatgatgacatacataaagaccacgatcatggcgtaagcaatgacggtgagtaacatagtcccaacctcttttcataagtttttgtctctaccgtcatagtacgtgattatcgtcacgaaatcgcctctttagcccgtttagaacactaaaagaacaatcactgatcttccgataagaaaaatgtcaaggaaaagcgaaaacgcctccattggcttaaaattaaccttttaagtcaacggaggcgtccatcagttatgaatcatctttggaaaaagataatgctggcgttatgttcatatattcacatactactaatacaggcgcgtaattctgtatcagtctaccagtcttggaaacgttcttcttcgagcttttttaacaactcctggtaatttttccgcgatggtgcatggctcaaggtcgtctgttgcagctcattaaatcgctctgctaagtaatatgcagtcagatagagcgtcagttttcgcttgacgatcgtctctggatctttgtcgtcaggcacttggtgcgattcaacaacaaggttcgcgaactgtttcggatttaaccgtaaatcatcgggttcatcggctttcatcgtgatacctccctttttaagtatgcctaatactaacataaaaaaacgaccgtaatctgttattgaaaaacattttacggtcttcgaaagtatgaagttagatgatgtaaaaatcttgctggcagctcagaaacaagccacacacgactgctcgtgggataaaagaggatcccgtttttggctgcatcacgggcggcaatgcgataaataactggatgagtgtcatgacgggcaccgacttgccgagcagtggcgacatcttcagacagatgcacaaaatcccgattcatcggcagtaagccttccttagcaatcacagtagccgcctgatgtgaggtgccatgatacagccactgcggtggttcagttgctggtgtgagcggcatgactggcacactgtgaccgtaaaccgcccgaatcgttgttccttccaatgcaaatcgctttttagtgctttgtgccataatagcttgtaagacttggcgatcaagatgcatttgataatgcgcattgaagcgtcgcaccaatgttttccaatctgtccgaccatactgatctaacaccaagcccaacttttctggatggtggcgcaagagcatgcttaacgtcttgctaatcttgactaatcgcttatccatcattgtccgttcccttttacaccctttaaccttaactaggagagaaaacgatgaaactgcatttttcaaaagcacaattgaacgaccttgatacgatcatgactatcgaaacagcaggatttacgccacaagaggccgccactagaacctgcatggcatcacgcattaccaactatccggacaccttcattgttgcccgcgctggtggcacgattgttggttacgtagtcgggccagcaactgatcaaccaacgattacagatgatcttttcagtactagtcagcccaatcggcccgatgatccgtacatcgctgtcttaagcctcgctgtatccccgcgccatcgtcatcaaaatgtcggctctcaattacttgagcaactaacccagatcgcacgtacacaaaaccgccaagcgatcaccttaacctgtctacaacggttgatccctttttacgaacatcaaggctttcaaaatgaaggtcgtgctgcctctactcatgctggcgaagtctggtacaacatggttaaaaagatgctctactgacagccttcctcagcttattcgggattcagatgttggcgcaacaccggggcggtttcgttgaccagaaaaagcgagccatctgcctgcgccggaaaactcgtagccaaaccgcctagatcaaacggttcaaaaccaatcgtccagattaacgacgccaccactttttttgcctgttcatcgtcaccagcgtacggtaccgcaatccgatcaactggttcttcaggttgtgccagcctagcgagaacggtcatcccaatcgtattaaacgctttgaccactttacttgattgaaaatgctcggcgacgacctgagacgtcgtttttttatgacgttcaatctcagcaatccacgcatcgcgatcaggaaaataattggtggcatcaatgatgatcggatcttgagccaatggtgccggtaaagccttaatcgccaaaaaaggcactgccaagacgacaatttcttgtgcttcggcttgttcaactgtgccagcttctgctcctagaacgcgcgctaaatcctctagcgcatcgactgaaccccgatgtgcgatgacagcttcattgcctgcttgcacgaaaagttgcgtcagaacctgtccgacattgcctgatccgatcataccaattttcatccgatatcactccaccctgttattattttcattatatcgcgacacctcttttcagggcaaataagccttgtttttttatgtatcggcttttccggtttggctttgactggatgtcaaacaatgctcatgctggtgacgctgagccaatcacttaagatcagttaacaaatagttttcaggcttcaactattttgctttacatactagtcaacgctctttatactactagtaggcaatgcatattagttgggaggtacatgtgatggcaacagataccaatagccaaatgctcaaggggattcttcaaggctgcctgttaattctgctttcccgagaagagctttacggctatgccatcagtgaggcgcttaacgattttggctttgttgatattcccaaaggcacgatttacccactcctgatgacaatggagagaaaagggttgttaatcagtcatctgcgtccctcacctgacggccccagccgcaagtactacgccgtcacagcagagggtatggctgcgcgtcaaacttttcaacagcagtggtcacaactgaaagaccatgtcgatcagctcatcaacgaggaggacaagccatgaaacaacggaaacaggaaacacagcgattaattgatgaaaatgaccaattgcgaaaacagcttaatgtggaaagtcgccattattatgaagacttaatcgtctatatgcgcgctcatacgctgtttcgcgatgaccatattgttgaagaaaacttaatggccattcttcaagacttgattgatgcacaacagaatggcatggatgctgaaacgtactttgggaaagatcccgcgaaaacgggggccgaaatgctgaaagtaattccgagaaatattgttgactttgcatggtttaatttgaagttaatgatgatgttagtccttctcacgctgctgccaaacctgacaactcccgaggtaaagcttgatagtggtaatcttctacttgtgaacatcaccattctgatagcgacatggagcattctctggatagttggtagtaacgcatttggcacaccatcgcgggctcaaaaagtaggctttttcattggtggcggtgccatttttgctggcacagtgggattgcttttcttttttaaaacaagttggcaactcacaatttcaccgcaaatttcgttcattctaattgtcagtggcttgattgttggtgcgttgctaccgttcttctctcgccccactggaatcaagttgttcctttacttttattcgatgggttatttactacttggtctgctcgtccatttaccattcacacgcaaaattatgacggcaaaaattcatttaggggcttaccagtggttactctgggttggtctggcaatttttgcaattttgataggactagtttcttggtggttcattcgccgagagcgtaggcatgacccagatagataagatgccgtgattaatttcgtgacgaggcaagttgcctcgttttttaatgtaaaataaccttaatcccaatcaacccaaaggagtgaccactacttggatctcaatgacacccttcgtcaccaactgcaccatcgttccatccgccagttcaagccgcagcatttaagcagcgccaccattcgaacattactggatgtggcgcaacatacagcgagttcaatgtacttgcagctgttttcggttattcacattatcaatcctgaaattcgtgcacaaattgctaaaatcagcacgcagacctatttgaacggcaatggtgaactgttcattttcatcgcagacctcaatcgcgttgcgaaactgacagcagctgctggtcaatcactggatcgtcttggccgaatggataagtttctgcaggcgagtgccgatgctacacttgccttacaaaatatggttgtcgcttccgagagtcttggcctcggaacggtaacccttggcagtattcaaaatgatgcgcaggccatgattgagctgttgcatctacctaagtacacctttccactacttggtctggcgattggttttcccgacgatgatccagacgaaaagccacggatgccacagcaattggttgctttcaccgaccactatgatgaacctgtcccttcaccaacagccatgactgactttgaccgcactgttagccactactacgccactcgccgcggcgatccgcgcgaagaaagctataccgatcttgcgattggcgctgccagcaccacgccggcaaaacgcggcgatctcttcaaagtcttaaaacaccaaggctttttcccggaaagctgaggttagtctcacccccaacctataaaaacatgccgcaccgagttctgtttaacgtcaaacagggttcggttttttgctgtcaacaaacgttaagcttgggccatatctcaagtcgtctcctcttctcaatcaccgtataagaattattgactgacgagtcaacaattcgttgactagccagtcaatcgcgactatactgcaggcgaaaaggttgatcagacaccgacatattaaaacgtgtttcaagtttgaccttaaggaggatgacaaaaatgacaacagctattatcgaacttgaccatcttcaaaaaaactttggcaagtttgccgcattaaaagatgtcagtttcacgttggcacccggtcaggttctgggttttctaggacctaatggggccggcaaatccacgaccattcgagttattttaggcttattaaaaaagagtggcggctcagtgaccgtcttcggcaaagatgcctggcgggatgatgcggcgattcatccacgcatcgcctatattcctggggacgtttatttatggccaaatctttctggcggcgaaattatcgacctattgctacgtttaaatggccgccagcataatcaaaagaccgatgaactaatcaaggcctttgaatttgatccgaagaaaaaagctcgtacctattcaaaaggcaatcgtcaaaaagtagcgttaattgctgcgttgtcgcaagatgccgatttgtatatttttgatgaacccacttctgggcttgatccattaaatgaacagactttccagcaagaagttttaaaactgaaaagagccggtaaaagtgtgctgctatcaagccacattttgtccgaagtcgagcgaatgtgtgattcaattgttatcatccgtgatggtagtgtgattgagagcggcaatcttgatcaattgcggcatctatcgcggattaaaattgaagtcagcaccgctaccccaatgactgatttggcaaagcaagcaggcgttcacgacctcacttatcgcgattccgagcacaccaaggcggttttcaccgctgatcgagacgcgcttggcaccatcatgaccacactggccgccaacaccgtggtcgacatgcaatcaacgccgccaacgctggaagatttattcctgcgttattatggaaagcaaggtgagacccatgcggcacagtaatcggaacgcaggttatctgcttcgggcaaacctcaaacaaaatctaaaattttcactcatctggcttgtcattttgatcatgatgattgccagtggtgctggcaaattggaagcagcctttgcaggcggggcctcgggctctaaagagattgtcaaaatgctgcgagcgccgggcatggcggcaatgtttggcgcgatgccaaaggtggacacgtataacacagcgattgtgtttgctggtgtgatggtcgtcttcatgattattttgcaggccttatgggttatgccgctgatgattcgcaacacccgcggtcaagaagaaagtggcttgctcgaaatggttcgcgctcgcaatgttgggcgaacggctgccatcaccgccgcttcgcttgagcttctcatcgacagtgccataatgggtatcctctattttgtctcgttggccgctgtcaacatgggtggtactgacttgtacggtgacttcctgttttcactggggatggtgatcgccaacttgctattcggaaccattgcgttgctattcgcgcaactaaccaataacacacgtacagccaatatgttgagctacttggtgctgactgccgcttatttggttcggctggtcaccgatatccagcatcaaaacctgacgtggttatcaccaattggttggttcgaaaaagcaaacttctatactgataacaacgtctgggccttaggtttggccttactggtcagcattctgcttgcggccagcgccaccatgattgcccgcaaccgcgatctgggcgccgggattattgctgaacgcaccggccgagccaaagctgccggctggcttcgctcgatccctgccttactgtggcgaacagagcgcggattatttgctgggtggttaatcggcgccgtggtgtttggcggcgtcatgggtagtgtgctcggcggcgttggcgacattcttaaaacgaatccgctttatcgtaaaatactagatgttggccaaatcaacgctgccaatcagaccatggtcctgtcattcttaggcatgtatctcggcattttcgtcgcattagccgtgactgctggcgtccaagtggcattccgactcaaacgcgatgacaaccttggttacttgagcgtcattcatgccgaaaagccaacgcgaaccacgatcagtgtcagctattattgctttgggctgctggcaggcgtgttcgtcctttctgccgggctgctggccttgttcttcactgggaacactgttctcagtcacccgttgccgctcaagtacctcggtcgcctatttgcggctagcgttccggctgtgatatcgtttatcgcccttggcatcgcactagtcggtctgtggccacgcttaagcagtctattctggctgtatatgggagccggtctgatcgttcaaattttccggggattgtttgatttgccaaaacacgcaggcaacttcacaccttttggctggattgccaatgtaccggttgaaaacgttgatcagacttggctaatcgtgatgatcgttggcgccgtgctgctgtttgtgcttggcattgccggttatcgccgtcaggatttgagcttatgaaaaatgttgtgacagatcccgaaaaagtcacccgtatactcaaaacagcgacggaaattttcggccagcaaggcttcatcaagagcaaaaccgatcagattgccaaccaagcacaagtatctaagggcttgctcttccattattttggcaataaacaagcgctgtatcttgacgctttcaaatatgcctatcatcgaatttatgatcacatggacccccaaaagtggcagaatgcccctggcttggctgccatgatgaccactgcagttaagtatgagttgaaactgcaattcaaattcccagctgaataccgcttgatgatgcaagcctatgctgatttaccgcattttcccgaaccgttacgacaacaagtgcagcaagaaacaactgccatatccgctgaagccgatcgcattttccgcgagaaaattgaacagctgcctcgtcgtgagggcctgtcagtcgatgacgttttcggtgtcgtttctgccttaatcgcccaacaaacagcggtcaccaccagactcattgccagtggccattatcgcaaatttgaagatctgcagtccgtggttgagacgatggcacgccagttattgattgtcgaacacggctttttaccagatgaaagttgacgtcagctgatcgattaaaaaaaccgcctgcactgatctgattcagtacaggcggttttttagatcataaaccagaaatgccttaccttattcaactttttttatacttgtcagcttgaacagacgagcatacaaccagaagtttaagatgccaatcgctagtagcaggccaaaagccagctgactgccaatcccaacattttgggcgtgagacaagcctggcatagtaacagccgtcatcatgccagctaaaacggtagtccccattgaacctgtcacttgctgccctgtgctatataaggcattcgcgtcgctttgatcatcaggttggatgactttcaagccatatgctgtactgttgccaaaagccatggaacggccgatggcaaaaatcagatacaagatcgtgacccaaagtacgctgatgtggcggccaaaaatcgtaaagccgagcacgccgagcgtaaatagcgtgttgccaagaaataacggcaaccgtccaccaaaatggtctaacatccaaccgtaaaccggctgaccaagtccattgaagacactgccaggcaagagaattaatccgccaataaaagcacttgccccgtcaacagtttgcacatagtttggcagcaaaaaattaatcccaacattcgaaaactgcaagagaatatatggcagaaaactgtataagaaccctggatcgtggaaaacatccaacttaaacaaagttttggcgtgatgatttgacaaccaaacgaaaactgtcatggctgtaaccacgatcaataaacccacacacgcagttaaccatttccgatcactgacaccattcaatgcaacggtcaaactgatcaaggccacaccgagagccgtaaaacgcagccaatcaaaagcaaaatctgaagttggcgtgtattgtttgattcttccctgtcccagcacaagtaacaaaattgcaaacggcaaggtgctccagaaaatcattcgccaatcaaagaagtttgccacggcaccgccaaaggttggtccaagcgccggtccaatcagaataatgaggttcgcgacgcccatgtagataccaagtttacttgtcggtaccgtatccaaaataatattgaccatcagaggactacacaaaccgacacaacctgcttgaaccagccggcccgcaagcaacacccagaacactggtgccattgcgcacatcaagtctccaataatgaacagcaatgctgccgtcacaaacagctgtcggttggtaaatcttcttttcatgtaagcagaactcagcatgattagcgccgcggccaaaagatagcccgaagtcacccactggacggtcgtcaaagacacattaaaatcatgcatcaaagttggaaaagtgacattcattgaagtttcggttaacacccccaaaaatgacatgagcgctacaatgctgatcacaagcaatgcgtgccgagcattagtttcttttacttcaatcgttgtcttcgccatgatcaatccccttcggtttctatcataagacgcaatattttcagtaacaacgtcgaattttaagagggcttatgaaagcggcctgaaatagcagccattttaacaatctttccatccataaatgcgctacgatagaagcattagttaacggaggaatcacacatgacaatcatcttgcttttcctcggctttttggtcggggcatttattatgacaatgggcggcggtggcggtgctttttaccttggcatcatgaccggcgtcgcgcatctgtcacccggcaccgctgcggcgacatcgctatttaccgccattccggccttggcggttgggtgttacagccattatcgtacaggaaatatgcgttttcacgcgggtaacgaaatcctgatgaccgccgtgcccgccacgattattggcagtcttgcagcgccacatattcccgaagtcgtctattcatgggcgatcgcggtcatttttgtggtgctcggtgtccaaatgttacgtcaatcgttcgcgcgcaaagtcaaaaaagccacccaacctgcgtggttcgcctatgtcctcggcgcaattagtggcctcatggttggtgttgccggattaagcggtggcggcccgatcatggccggtctcatgttaatggggctcgacatgcctcatgcggcagcgacttcttcgtacgctttagttgctttgtcagtcatcggctgccttttgcacgccacccaaggcacgattgcttggcaggtcggtggcttattgatgttaggctcgctggttggtgccgccattaccccgcgtattctcaatcgcttcgatccgcgcctgctgacagctatcttgcggccaattcttgggatcatgctcctgataatggcggtggcccaggtttggtaacgcaattcaactaacttaaccaacagttaatttttctgtgccaaacttgaaaacggcgcgattgttttccttcaccttggcaacgataatgaaggtgaataaggaaggggtgaacgatcatgcatattgatcaagtgattcgcgaacggcgcctagctttaggactcacgcaagaggaactcgccaacaaaattggcgtttcggccccagctgttagtaaatgggaaaaaagggtgtcatatcctgacattactttgctgccagcgttggctcgcattttaggcacggatgttaatacgctgcttactttcagtgtcacgatggatccagaagagagtcgccacctatacgaaaaactgatgacgactgccaaagatgccggatggcaagcggccgtcgatctggccgaagcgcagattgcacattacccgtcaatgaatagtttgcagttgatgattgcggcttttttacaaagtctgaaaagtcaaatacctgaagcagactggccttcagtgtatcaacaaattgttgccatttatcaaactgcggaaaagagcactgatctgccacaggcacaagtagcggcccaaagtctcttttacctgtacctcaaggaaaaagattttgatgctgccgagaagcaattgacgctgttacctcctgaagtagtcgcctataacgccatggagccaaaattgaaattacagcgcggtcaactcaaggatgcttacattagcggcgaaaagttgcttggtactcgcttgggggccgtctcgcttattctgaatgtactcactcaagttggtcttgctgatcaccagcttgctgttgccaaacgttatgctgacatgagccaaaaaatagacaacctgatccctatctccaatccttatacgctcgaagctcagttgaaagttgcagaagctagtaatgacccaaatcaagctgttacgatcattaaagaggtgttggccaatctcaatcaaccgcagccactggtattgcagcatttgaccccagccaaaagcaaggaacaggtctcgctcaaggaagctcaacggcaactgttgcaaatcttcaccgctgatcccgaaatggcttttctccaaaaaaatcccagctttcaacaactgctccatcaatacaatctctaacaaaatgacatcatgactaaaacacgaaaggccttcgacaggtagcaagttgtcgaaggccttttaatgtctcattcaattaaatcagttcgtaattttcccattattcagaaattcatacagataccgattcaccaatgggttgtgctcatgtagctggctatgctgcgccttgctattggtaatctcgcgctcagtataacttttcgcccgcccggcaacaacataccgcaaggaacgtgctgaattgactggcactcggccatctgtgcccttgcctaggttaccaaacagattcaaaacggcggcagttttgggaaaatacctgcgattgtcatacaacggtttgtaccgatccgacataacgttaggccgcccgtctttagcaagggtaatatgctgtccgccgttcattcccggcataccgggaaaaccgttaaacggcccggcaatcgtgattagtcgccgcaattgcggcatcccctgcttatctggcgtcactgcccagtttgcccaagcagcggaaccggccgagtgcccgacagcgttgaagttcttgataccataacgtttcttcagttgtttgagaattttacctaaggttggcgcatctggtcggccgctgctgaagacaacggcaatcagtgggtgtttcacactggcagaccaagaaccgctcacggacaactgcccagtgttggtgacggtatagcgtaatacttgctgatacccgggatgtttgctgagatcagcaatcatatctttttccgatccatagccaccaccaaaaccatgaacaaacaatgttggcgtttggtacgtacctgctgctcgcgcagtggacggtgccgacccgcgattcatccaaaaccacgcaccgccactaatgatgagtacgatgaccactgccagtatgactttgatccattttttcatgagcataagccctcgccttcatttgaagcttcatgctttgcattctaacacgatctcactaaattaaaaccacaaacgctcttgcttcgtctatcaactatttaagtgaattaacttgccaaaacacaaaatccttggtatagtgtattagcaatctaatacactagtaaggaggcacaccgtggaatttgacgataagatcccaatctattatcagatcaaacaatacttgtatcaggaaatcatcaccgatcgacttaaatcaggcgatcaactaccggctgttcggcaacttgccgcagacctaaccgtcaatgtcaacacggttcagcgcgccttgactgaactcattcaggaaggcgtccttgaaacaaaacggggacgcggcaatttcgtcacaaatgatatgaaagtgctaattgatatgaaaaaacgcgtcattgcgacagaattagatcgcctttatcaccaactatcagaattgaatttaagtgatgaggaaatgaaagacgcattcgccgcttatgttgatgagcaggaggtaaaacatgacaactaacatgatcacagtcaaacaattgacttataaacgcaatcgtaaagtgattctggacgacttgaatcttgacctcgttcaaggtcacttcatcggcttattaggtgcaaacggtgccggcaaaaccacattgatgcgactgttaaacggggtcgcgaccacttttcatggcaccattcaaattggctcatcagaaagtattgttgaacggaaacaactaagcagcttcagtgaatcgttaaatggcgtcaacccaaatcgaacgctcaagcaaattgccacttattatgccgacatgtatcttgatttttctgaagccgagtttgctaacttcctgaaaacatttgatcttgattcccaccagaagctggcggccctgtcaaaaggtaaccgcaaaaaactgatcgcagcgctgactcttgcccgtcaaacccaactttatctgttagatgaaccttttgaaggtatcgatagcatgacgcgcaaacggatcatcagtaacttgattgcgtggaaaccggcagcggcaaccgtgattatttcggatcatcacgtaggcgacgttgccaatgtgttggatgaggttgtcatcattaaagacaagcacgtggtggcacagaaaaatgccgaagagctgcgagaagaaaccggtatgagtattgaagcctattatgaaagtttctatgaaggaagtgaccaacaatgactaatacatggacaatgatgcgaaccttgacccggcaacgttcactaacagcatttaaaacattcatcgtgactttggttgcgaccgttgtatcaatcctactagcgatgttcactggtgaagcaaaaatcaccgttgattttgtcttaacccttctctttgcttatgctgtaattggcggtttggtgttttttgttagattggcgatcattcaagagcgtgtttgggtcaataactactatcgatcagtgccaaccaccaaccttaaactttatactgctaatctgctggcaacctgcctatcatttctgatatatgctgccttcgaaggtgttgttttactagcacttgcagtgacgcgttggggtatcaacttaccaacgggtgatcccatgaccgtgttagtcgaaatggggatattcctgattgtcttagggatatttatctgggcatttatcagtctcgttcacttgttatcagtgaccattatggcgttcctgccagaaactcgaattcgccttgttcaatggattatctatctggtggttatcattgttgcttcgttcatattcgatcaggtccaacgcctgttcttactaccctttggtggttatgacagcaatactttgacaggttcttcaagcgttctcgtcggcatcgggatcttcatcgtcaccattctgctgatctctgcagtgaatgtttacctacttgaaaagtgggtcgaaactaaataatacgccctaaacgatgaaacctattgacaaaaaaatggggaaaatatgcttaaaatcatagctaaacaatttttacaacactggaggatatggctggccctcttaccgattttcattgtttccggcatcgtcttcagtacatctctaattttactgacggcgatggcaaccattcctgtcgcttcaggcactgattatggtgtttttatgcaaacgccgatcatcattggtggggtcgttttgtgcttattaacgaacaatgccatgaaacagtgtatcgatttctttgatgacacgaatgatgtgatgctcttgctaggggcatcccctgtccagttaagttttctgatgactgggcaagtgctcctgactggtgtccttggcgcggttatcggcatgcttttcgcaatcccagctggccgcggttttttaagcctcttacccgtgagtgcttcttctgagtctttagtcaggctacctctgagcttctcatggcaaatggttcgaaccgttttaattcttcaggctttgttgatcgtgatgacttgtatgcgttactgccttaagacttaccaacgaagaaaaggcgcgttagttgcgagtctgcacaagcatcgaaaaatcgtcggtagttttctaggaatcgtcacccttatagcaagtttggttgtgacaatcctcctatttttaaaacctgtgcctgatccaacttcagccaatgcgtataacaacagtatgaagggttcaatgaattttttactgttgctatggcctttagtgattatcagcatgaacttcctgatcagaccgttgtttatcaaaatggttcgcgtcattgttcatataccgtccatggccaaacagccgatgatccgttccgcctttcatgacttgcaacaccacgaggaggcggtcattaaattaattcgcccggtcagtgtcatcgtgttacttgccggaaacttcatcgctttgtttcttaatacgaagctgctagtggatggcaacaatggcggcgcggttatctatgatctggcagtgagtctgatttttgtatttggggcacctatcatgattagtcttgccagtattttgacatcaattagtctttttaaaatgaaaacggcagcagaatctgatcattactttttctctgggtgcaccccaagctggatcttcaatttaaaactgaccgaaatcggtgctgcaactattctcgcaatcttaataacatttcttggaacaagcctattcgctattccgctgttgcgagttgcgtttttaggcggcggtgatctttctaaggcaaactggaccgtcaatatcctcctgacttttggggtattcggaatatttttcctttgtttgacgctggtctattggtcagaacggacgcaccgcaaagcttatgtcaatgaataagcatacgaggaggaaaagagatgaatgatgtagtcgtttccgtcaaacatttaacaaaagaggttgcgttagctcagggaaatacgctgaaggtgcttgatgatatttcttttgacgtcaatcaaggcgtatttgtgtcgattgttggtccatccggatcaggaaaatcgacactgctctactgtatttctagtctattaccaccttctaaaggcaaaatcctgattaaaggaaaatcaccatacgagtggcgtgcttcaaagttggcaaaatttcgtcggaaagagataggttttatttttcaggactttcagttagtcagctctttatctgcttatgacaatttactgcttccgggtattctaaatggtcagaaaattaaaccgccaatggttgacgcattagcagcgaaactcgaattgacagccgagttacaccagtcgattgacgcgttttctggcggagaacgacagcgcgtcgccattgcgcgaactgtgcttgctgacccagatatcatttttctagatgaaccgacaagtgcactagacacgcattcacgtcagttagtcatgaagctatttcaagaactggtcaatcaaggcaaaactttgatcatggtcacccatgatttagaactcgctggggaaacttcacggtcgattgtgctacgagatggccgaattgaaagggagattcaaatgcccgcggctgaaactgtgcgtatctgaatcattggcaggcagtttctgtttagctaatgattgaagtgatattacaattttccagttcatttccacgtcctcttcgcatcaacaatgaaacagcgtccctcagcctttttaaggcatgagaggcgctgtttgtgttagacctttctgttcatttgtaaccactcgctgcgtaataaggagtattcattttcatcatggaaaccatctgctagtttttccccggcgcgacgggtgccatcgtgatgaaagccggccttttgagcgacggcattgcttggtgaattgtcaacagcggcgcgaatgatgactttattgacgccatactcttcaaaaccgatccgacacatcgccaacaccgcctgatgcgctaggccgcgaccacgaactgattttttaagccagtaaccaatatcaccactttcatcactcgggcgaaaatgattgaagctgatcatcccaaccggctcatcccgataccataaaaccaagttcattgactcctcacggccaaaatgatcattgacgctccgcaaaaatgctgcttcctcggcctccgtttttaatccattcgcccaaggtaaaaatcgaccgatatcatcgcgttcttgatcgataattgcaaagagcggtgctgaatccagccgcggacgcggtaatgccaacttaaaatcgtcatcaatcacataacttaacatgctaaacaccttcatctcgcgtttattgcgctaacacccaatgcgccggtgctgcttcgaccagtgaggcagtcggatcaagcgcctgccggtcaaagtgcaacaccggtttttgctgctcaagcattggatcagcctgcggaaccgatgacagcagcgtctgcgtgtaaggatgcagcggatggtgataaattgcatctgtatcgcccgcctcaacgatgcgaccttgatacatgaccacaattttatcactaatgtagtgaaccatcgatagatcatgggcaataaaaagataggttaagtgttgttcatgctgaatttgccgcaacaaattgacaatctgtgcctgaatcgacacgtccaacgctgaaatcggctcatcaagcactaaaaacttaggctgtaccgccaaagctcgagcaatgcctattcgttgccgttgtccaccagaaaattcatggggaaaacgattaatcgcgtctgcaggtaaaccaacctgcgtcaacagtcgtaaaacttgcgccagccttgcttccctcgaggtggccaaatgaaaattgtcgatgccttcagcaatgatatcgaccactttttgccgcggattcaaggattcgaacggatcttgaaacaccatctggacctgacggcgaaagtctttgcgcgccgcatgtgagaaatgacggatcgactgaccgccaaaaagaacatcaccaccggaaatcggaccaatcccagcgatagcgcggccagttgttgtcttacctgacccagactcgccaaccaaaccgactgtggttccggcattgatcgtgaagttaatttgatcaacggctttgattgcttgccgccctttataaaaagtgacacttagatcgttcatcgtcaataacggttctgtcaaactggcacacctcccgcttgctggctttcaactactggatcgtttgtctgttcagcatgcaactgagcaaatcgcgcccagcgtttctgaatagtgactggtggctgatagtgtggggttcgtggatctaataaccacgagcgtacaaaatgtgtcggcgatacttgaaacaacggcggttcttttttaaagtcgattggcattgcgtaaggattgcgcggagcaaaagcatcccccttaataggttgatgcaaatcaggtggcgttcccggcaaggtaaacaattggtcacgttgatcatctgaactaggaacggcatctagcaatccccaagtatagggatgctggggatgatagaaaatctcgttagctgtccccacttcgacaattttgcccgcatacataatcgccacacgatccgcaatgtttgcgaccacgcctaagtcatgagtgatgaaaatgacactcaaatcatgtttggctttttgcgctttaatcaacgccaaaatttgtgcctgcaacgtcacgtccaacgcagtggtcggttcatcagcaatcagaactttgggctgcatcaccagcgccatggcgatcatcgcgcgttgacgctgaccgccagaaagttcatgcggatatttgcgggcaatcaaagctgggtcagctaatccgacatcttcaatcgccgcaaacaccgcctgcctcaaggcgtgaccgtgaacatggcgatgcaccttcaagccttcgccaatctggcggccaatgcgcatcgtcggattcaaaccgctaagtggatcttgaaaaatcagccccagctcttgcccgcgcagatgggtgtactgacgccgactcgtctgcaataaatccttctcgccatacagcatctcgtcagcagtcaccacagcatccttgcccaacaagcccagcaaagcatgggttgccaccgacttgcctgatcccgattcgcctaccaacgctaatgtttcgccttgatgcaaacttaaatccacgccgttaacggcataaacttgttcgttgccttcattaaaaacgacttttaaatttttaactgtaacgatgtccgccatgtgttcacttccttcaatcgcattctggggtaacaatgccgctaaccacttactttttatatagaaatagatcgacgataatgccgccaaacaaattgatcgccgttagcacactcatctctaaatttgtcggtaagtgtttgataaactgtgcggtcagatggccatgcggtcgttcagtatgccaaatcaatctcatagccagcaagaacaccgtcacacctgcaagaagccaaaaggtttgatgaagcccccacaacaaggctagcaggaaatggttctggcgcagtgcaaggcctgttgtcaccaataaaaggccagcaaacgcacctgcgacaatttgccaatgatgtttctgcatcactcaaaaaacctccttttcttcgcattgatttcaggcacataccagtagcttttgggtgagacaaaggtcgtctcttactgtcatgtgcgctaaaattagcctagctttggaatttagggtcaagcgcatcccgcaagccgtccccgacaatgttgaaagcaaaaacaattgcaaccaacactagaatcggcacataaagctgcatggggtgctgcagcatctgatcctgaccatttgaaatcaaaatccctaagctggtattgggtgcctgaatgcccattcccaagaaacttagacttgcttcaccaaaaatattctgcggaatgctttgaccgatgtccaaaatcaaaatgctcatcatgttgggtacgagatgtcgtgtcataatccgccatagcggggtgtctaacatcactgcagccgtcacgtaatccaacccgcgcaattgcatcaccaaaccgcgcgcctgccgtgctgaactcgaccaactagtcactgccagtgcaaataacatcgtccaaacgccgtcgcctaacacgatcatcaacagcatcgtaatcaacaaactcggaagtgaattgaaaacttcaatgatccgcatcatcacttcatccacccagccgccaaaaaatgccatagtcatgccgtagatcgttccgaatccaatcgccaagatcgtacttaaaatggcgaccaataaggacacttgaaccccaaggcatagacgggtaaaaagatctcgtccaagtcgatcggtccccagccaatgcgcagcactcggaccaatattccgactgtcaactcggattagatttggatcatagtgttgtatttttggcccaataagcgcaaccatgacaattaaaatcaaaatcacggtccagaacatggctaaccgatctttgaatagcttgtgacgcgctgaggcccagaaaccaacacttttaggcacaccatcgtggacattgatttctggcgttgcccctgactgatcaaaagttgcgtcagagacaaccggtgcagcttcactaccaactgtcggtacttttttaaaaaattgaaaatcctgattgcttgcggccatgtgttgattagcctccttaatggcactttgtttaaaagcgttcgccagcccagaaaccggagtgtaagggcctcaagcgcaatgatcaaagtacggccatcacgcttgaggcctcttacactccggtttctaaccgggctggctcacgctctgtcatataatttaatgcgtgggtctgccaaggtgtatagcatatcggtgatgaacatcgtgacgatgtagaggatggccagtaggacggtttcgcccatgatgatgggcacatcgcggttgtttaaggcggtgacgaagtattggccgacaccaggaatcacaaaaatgctttcgatgaaaattgaacccgtgatgccgaatgccaaggtcaccggcaaagaagtgatgatgggaattgaagcattgcggacaatgtggtgcaacactatctgcgattctgatagtccttttgcccgagccgtcatgacatattcgctagaggcaacatccaccatcgaattttttaaaaggcgggcatagattgcgatgtaagtcacgccgccagcaatggttggcaaaatcgtataaatccagccgccccaccaagtttgatcgccgctgggccaaccaatgattggaaaccagccaagtttgcctccaaagtagctttgcaacaacaatcccagcacaaggctcgggattgacatcagaaaaagcgctacaatggtgaccgcccgatcaagccatgtatttttatacacggctgctaaaatacctagtaacaaccccagtggaatgccaaacagcatctgttgaatgcccaatcgagccgatgcgggcaagcgatcccgaatcaagctgctaatcgtcactgacggatcagaaattgattcaccaaattgaccatgaagcatgttgttcatagtgataccataacgttccaatactggcttatctaagcccgtattttgatacacctgtgctctggtagctgctggcaatttgtcggtttgcgcactcaacgcatctcccggaactgctgcgaccataaagaatgtagccgttgcgattaaaaaagtagcaatcagcaattcaacaaatcgtcgaacaatcaatttgaccatggtgctaattgcccccttttgacatcgtcatgccgcataaactgacatctcctttaaaccccgatagacaccaaccgccaacgtcaatcagcatcaaaaagtcatcattcttttgatgcgtaagtgtaattaaacgtaccgccgaagaccgtcgtttggagattcttgacagacttattgatataaatccgcgattgcgggttggtcaatggtacgacaccgaagtccttggcaaccaactgattttcaagctgcttgtagagcgttaatcgttgtgccgccgtgaggttaccgtttaattggtcatccagatcatcaaaagtcttgctgttatagccaccaaagaatttttggaatccattgccagaattccataggctcaagtaggcgttcggatcagccgttgctaaccagccattggccagcagatcgtactgattgtcatttcgcatttggataaagctggcagtatcaggtgctgttttgacggtcactttgacaccaagattttcctgaatcgtttgcttcaaccatgtggccgtatcatcactgccaagcgtcaaataaacaaagttgagtttagtcaaatcagtcgacttccctaattcttgtaaaccttctttcaacaatgcttgtcgcttcgccttcgtgttgtattgtgcctgtgccgttttcaacggattgccgacatactcgccataattggtcccgctcacatccgacgactgcggcaccatcgtgtatgttagcttgtcccgaccatcattcactgccttgttatagctcgttcgatcaattgacaaggaaaaagcttcacgaaccttcacatttttgaaaagtccttgggttccaccgttgtgttgattcatgatcaacactttcgttgtcgaaccgttctgttttcgagagacgagtttgctgcttttggcgagttgattaaaatcgctgatcagcttgcctgaggcagatagtgcgtccaactgaccactttgcatgagcgaaagaaccgttgatggttttttcaccgttgtgtaattcacggtctggagcttcactttcttagcgttccagtatgttttatttttcttgagcgtgatcttgtcgtcctttttccaagacgtcaatttaaacgggccattgaaaacttgatcttgcacatcggttttccactttttgttgccgactttgttaatcttgtccaagcgcactgggtaataaatcacggttgccatatctgacaaaagtgatggataagcataggccagcctgatttgcagtgttctcgcatccaaggctttcacccctaaatcggccacactgcctttgccggtgttataggcttcggcccctttgataaagtacgcgctcgaagcctgcgcaaaagcattttctttcttcagcagacgctgaaacgaatcaacatactgctgggcagtcacggcttttccgtctgaccattttgcatcgcgcaacttgaatgtataggtcaatccatcggccgacttggtataagatttggcgccggtcagcaccaccttatccttgccattcgtcgattcaatggtcgtcagcccttcttgcacctcagacaaaatgtcattttcgttcgagttccgcatatcattcacatcgagtgtggttggatcatctgtttctgacaaattcaaagtctgccttgaacccgacgccgaagtgtttttactgccgcaagcgacgagaatggtggcgagtgccaagccggtgataagtgctgttaccaagtggttcttctgcataaaaaattcatctcccaaaacaaaataaaactggcgatgcatctagagttctagatacaccgccagttttgtccttcgttcaagtcaagtgatcccgtcacccaaaccaaaccctagccatgtaaatagaactgctgtgtgagtcacagcagcagcacattgacatggacatggcttggttaaactttgtcatcacggcgactccttccgaagaaattagcaacagcatacttttaaaaaaatagttcgtcaatgtgaaaatttaaaaaattgactcattggcattgcatcatcgtcatcatttggcaacaaaagttcgatgtatcagtgcttataggcaacataaaatcagcattaaaaaactaatgtttgagttgcggtaccagtaaatcagtcagtgctttgacagaaaatgggttttgtccggtaattagctgaccgtcttgaactgcaaacgacttatatgctcttttttgtacaaaatgagcattgtgtttatttacaaccgttttgtttaaaaaaggaacaactttttgtttaccggctaaaatctcttcagcatgtgtaaaacctgtgatcttcttaccagcaatcaaatactgaccagcttggtctttgatatttagcaaaccagcgacgccatgacaaactgatgtcacgtatccttgatgctgataaattgccagcgctattgcttgaagtgcctgattgtctggaaaatcccacataacgccatggcccccagtgaaataaatggcgtcatattcagctggattgacttgctctggccgtaatgatgctgtcaaagcgcgttcttgaaaatcgtgatcttcatatattttcatgattgctgggttcgtatatttcatgcttcgtggatcaagggggacaaagccgcctttcggactcacatagtcaaccgcgatgttggcttgctgcatcgcatcaacaaattctgctgcttctcccaaccacaatccggttggttcatctgtatgctgataacgggttgtattcgttaacacaacaagtacttttgtcattttgctgcctcctgaatcacggatgtcacatcatccaaaacttgtttcagctgattaattgagcttgtatcatgggataaataataataattccgcgttccctcgcgccggtatgccactaatcccgcctgctttaagattttcaggtgatgtgaaaccgcaggccgcgataacgcagtcgccgtcgtcagttcacttacgcgttttccctgacaaggttgatccgctaacaaagcgatgataatcgcttgacgcttttcatcgcccagcgcgacaagaaaatcaccaacatcagatagttctttttgcaactgttttaggcttgacatttcttcaccctttcgtttaattatttaaaccattaaagcatgtgctgtcgctaaagtcaaccaatcaacactcgggaacacagtcaagctcactggcatcctcggcaggtaggcacgcctagccaccgacagaaaaaagccgatcacggtgagttgccgtgatcagcccgaatgaacctaaaaatgccgtttgaattaacgcctaggcgtgcgctggtttgcgcattaaaattgctaacaaggcaattcctgcaagtgtgaacaaaattgccggcatcaaattagcggccgtaaacatcacgaaggccatcgtggcgaacaagccgccgatcgacaaaccaatgccccatttttgaacggctgtcaagctatggaaagaggtgcggaaacctagcgccagcaacaatgaaccagcaaaagcaacgagtccaaaaataatgtggcctaaaatcaaccagttgaacatatgtgtctcccccttatcgtttgcggacaaatgccaactgcaaaagcccgtgtgtcatttaaaagtatgacgccttaactatacgtgagactatcacccctgccaactaaatctttcgagaataatcacccggtaacatttcgcccgccacatggagttggccgtccttcaacacgactgcatgatcccaaaaacggccaatatcatgccgatgtgaaatgacaatcatcgccaccggcagctgccgcaggaggaggccaagtgtccgtgccgaggccgcatcaagatttgcgaacggttcatccaaaagcaacatcggccgctgagccagcaaagcacgggcaatcccgatcttttgcaattccccagccgacacattgacaccatcttggccatgcacaggcgtggccagtccttgcgggagacgcgcaacaaaatcggttagcccaacttggtgtaggacaagtgtcagttgctgatccgatacctgccggccaagcgtgacattattggccaatgtgtcctcaaataatgcaacaacctgcgggacaaagctcatgctgtttgctgatgccgccagattgcgcttgtctgcatcttcaaactgaatcgttccagcttgtggcatcaataaacctagcatgagacgaagcaaagtcgatttgccgccaccacttggaccagttatcaacatcttcgcgtgtgcagtcacgtcgagctttaactgtagctggttcaaagtcggttgcgtagcatcaggataagtgtaagtgacattgcgaagaacaaatttagctggtttttgtcgcgactgtccacctgccaactcctctttatgcagcgattggatcaacggcaacaaccgtttggcagacaccaagttgcgcgtcaattcagcatactgacttggcacactgtaaaacaaccaagtaaaacttggtgtcaacatggaaaatgcagcaaattgaccaatggtgatgaccttgaagccaacaaatagcagctcaatgcctaaaatcgcaatgtcaaaaacgagccccaacgaaaatcccatcacaactgttttgacttgttgcatccccatctgatactgtgcctgagaaaacttctgataggcgccgttaaatagttgcataccaaactgttctttttgatagctttttaacaattcgcggccgttcaagatttgcaagaggctttcctgcatctgactattctcaatctgtcgctgattttgcgctgtttgcaagcgaccggacatcatcttcggaatcaaaagtgccgttgcacacagactgatgatcaatagcgttagttgccaagagctgaatagaccaaatgttccagcggctaaaaaggaaaaatcaccaaccaccaaagccgtcatggaacgcatcaacaacggcgcagcagtctgcgcatccgtggtgaacccgttggcccgccgcccgctagcttgattgtcagttgcaatcggcccattcatcaaagctgccatcaattgcgtttgaattctttgaatcaattgatactgaccgcgcgtttgcagctttgccatcacaaagcgaactaaccctatcaccaaagctgtagctgcagctaacgtgatcatgctgactgtaaaagtagcatgttgcatcacactttgaatcacttgtgccagtaataactcaagaccagcacaccccaaggccagcaaccataaaatcgagacaagtggactgtcaacaagccgccaaacttttttcaaatcagttatcatggtgatcacccaccttcaacacctgatcggccgcagtcacaaaatcaaacgtgtgcgtaatgatcacaaccccgcgcttcttagcttcctgccgcagcagttgcatgactgcctgttgattaaccgcatcaatgtccgaaaatggttcatccaaaacaataaatggacgatctgcggcaataccgcgaataattcctaatcggcgctgttcacccggagacaattgattaggttgtaacgtctgttcaagatcggcagcataccgatcaagttgcagttgctgtaataatgctggcaactttgtcggatcagcctgagaagccaatagcaaattagccgtcacggatgccgtaaacatcacactccgctgcggcacaaacgcaaacaacgatgctgacttgattttagcaggcacaccctgaatctcgattttgccagtcgttggctgcaattcgttgagaatcagcttcagtaaggtggttttcccagcaccatttgcgccgatcaaaaaggtgatgccttgattatgaatttgaaaatccaaatgttgcaaaatctcccgattcgtttgcagataatggaaactcacctttgtgccgcgaattttgatcgtatccggctgatagtcccccttcataggcgaaaatactggcattacctgctgtgtcagtcgtggcaatacgcgatcaatagaggttcgttgctgagccaagaaaccaatcgtcggcgctaatcccaaaaatggccataggattgagcccacgccagcattccaggcacctaacagaccggcaactgagctgccagtgacggttaacatggcaaaacccaccatcaacgttaagacctcagccaaatagacgccaccattgaaaataccggcaagcgcgccagaggccgttgccatttgcttcatgcttggcgccgcttgctgaaaataatcagcgtgtcgttgacgactgtaagcaaacacattcagattgcgaaccacagcgacatttgccaaaaaatcattgaaaaacgctttgtgcttgtcatcaatttgaataaaagtcgtttgcgcttgactttgttgacgaaacaagccccgcgaaacaccggcaaataaaccgccgaatgctacaaacatcagtgccaactgccaagactgcgtcacgacataaatgacgccaagaaaaaccgtgatcccaaaatcgaccagtggcaaaacccctgcatccagaaattgcatgatatgctgcgtgtccgttacgatcaaattagtggcagttccattatcgggcacctgtgtcgcgtcgtcttgcaaaaagttagccatcaaagcggtcgcaatgtcaccactgactcgtcgtttgagacgttctgtgacaacgcctgccaaaaaataaatcccagtgtagacaaccgctgccgctaacatcccagcgaaaatggccacaagcaagttgacctgtcctgaaagtgcaacggtcaaaccaagctgtatcagcatcgaaattaaaacgttaaaaccatcaatcagcactcgtagtgtcagtaagccaagcaaccagcgatatcggatagaagtgattcgtaaaatagtttgcatgctttaagtccccttcaagcgattggtctggccaatcgctaactgttgggactgcgcttttggcaacatcatgcacctacgcgacagcttcaaaacacacttgctcgcggccacacaaaaagacggcttcgcagccgcctttaatcaacgcaaataaaacatacacatgattaacgaccagaagcatccccgcggaccgcaaccaaaaaactgattgccaacgcagtccctgcgttcaaatttgatagggtaaagcgtccattgatccgcattggaaaatgcctccgttctgtttcaaattttattagctgtagcttagcagacgacaaaaccatcgtcaattaatttgcctcatcagcaacacaaaaagtgtacccatttcattttcactaatgcgctaaatcatcacagcaccaattttgctaacaagttgcgccgctaaccatgattccttttttgaaggctgccaatacatctgcaccattggcgattcgaacactgccatccaaataagcgtgagcatcatccttaatgctgatcgccccattttgaaaatccatcgctaaaccgctggcaaagaaaatcatgtcatagtcagacgtatatagatccagacccgcatcattttccaacttcacctgatagtccgaatccggctgatcaagcacaatcaacgtaaacttcgtcccgatactgcaggcgccgccttgcaacgaataccgcccgccaccatcatctgtaatcagcaacaacgtcttctgatcaagatgcttcttcttcatcaaatcaacaaaagcctgcgataatttgatcgttgccattgtatcgtcacctttcttgttacttacttttagtgtgacactttcgggcgggaaaatcaattgtgcgcgagtgaattaaccattcatttgatcataccagtgatgaaacaagttcgattgcattttgaaaaacgcctgcaagactagcttgctcattgatgacaatcaacaaccccttcaccaaccaaagctgaaccgtcatcagaaaaagatggcggtcagtaatttgaatcccagataaagccaagaattcattcaaatatgccgttagatcctgtttatttttcggcataaaacattgaaacaacgccgcaaagtccagaaacttcgggccaagccgagtttcaccaaagtcgatgacaacgacttgccctgagttagtcaccagtaaattccaatcctgttttttggagaaagaatcctaagattatccatccagatgtttgatactttagaaccaccgcaggaatcgaacccgcgtgcgaaagagattccgcagcaccagcgtggttaaagatcattttaggcaaacattaattgccgttgtaagtcccatcattacctgtagcaacagcggttgacgctgcgtagtagtcaccctgatcaacgacataaactccgataacaatattcttgaaaccagagttaatgatgttttcgtagtgaccgcctgttacgccgtgattgttttctggacgttcgtcaacaatgtactgttggaacatcgcattggcaatcagtgtgctgagtttatcagcactaccgtcaacatcctttttccagagcgaagaagtcgagatgttttcagtgctgcgattcatgtagacttcgcccttttggtaggtgacatcttgcgagccagttgctggtggattgaccggacgggtgtggctgaatttatacataacttcgaccgcgcgcggcgcttccatcttgtaggcttttggatcagatgtgagcacagtctgtgtacgaccagttcttgcttgctcgccattaaccagcacattgaacttcttggcaactgctagcgtcaaatcggcgtcagtgtatgcttcagcttgttcaatggagaccttctgatcatttgtctgaatctgtttttctatgagtttcgttgtcgcatcgttgacactcttgatggcgccgatgatggttccggcagcctcaacgttgcgccaaatattagtcgtggtgactgtcgtgacagtgtccccgtatccttcaattgctgttgtagacgtcggtgttgacgaaaccttgacgtaaccagtcttatcagtcaaggtatagccgccttcattcacgtcaacttctttgtaaaccgttttggcttgcgtcttatggtacttgtttgtggttgtcacaaccttcgatacaacattaccgttaccatcaaggccaaagttcgttactgtcgtatttccaataaagtaataaccatccgttgaagtcaacaccttgtcattttcatcaacattaacagttttattagttatagtgacgcctgtcgtatccttcttccagataatcgtagtcgtgaaggtggtcgtcacatctccagttacagggtccgtgacatccgttgtcttgacagaactggagtcctgattgtaaccattcgtgttggtcaaaaacttccctgattcatccaggttcacggtttggttcttgatcaaacgctgcggcgtcttttcccaaacaacggttgtggtaacagttgtggtaatgttaccggtcttaggatccgttgcatcaaccgactctttagagctggatacaattgaatagccgtctgtatttgttaaaacatgacccgatttgtcttcattaactgtcttaaggtcgtacgtgtgtgttggcgctggggtctcgttcttcttccaaacaacggttgtcgtaatggtcgtggttatattgccagtcgtaggatcggtggtatcaacagatttcttggaactggatacctgcgtgtaaccgtccgtactcgtcaaaacattgccggcttcatccacgttcacagtcttattgacagtcacatgagtcggcgtctcagtcttcttccagacaaccgttgtcgtgactgtggttgtgatgtcaccagtcttaggatcagtggtgtcaacggatttatccgaactggagacctttgtgtaaccatctgtgctggtcaaaatattgccggcttcatccacgttcacggttttattgacaacttgatgcgcaatcttgtgatagatattggtcgtagtataagtcgtaatggtatcaccattagccaatgtttcaaccgttttaactggggtaccagacgtgagcaacttgtaaccagtaagatcggttaggacctgaccattttcatctttgttaatcgtaacctgcttttcggtatcctgtggtacatgaattgttggaattgtcttttctgcatcagcaactgtttgctgaactgctggcaatgtctgttgatggtctgtcgtatcaaccttggatgcttgtgtttcagcagttgttatattggccttggctgcttccacattggtttgggctgtggtcaactgatcctgccatgtagctatctgggtatctaaagtcttaatcttttgatcaagctggttgatcttcgtattcagatcagtgagttgtgctttgactgcttgcgcggcttgactattttggctggcaaccgatgtcggaagtgcctttaaggtcgtttgtgcctgtgcaaaatcgttttgggccgctttggcttcattgtcaacgctgatcagtgcctgattagccgtgttgagattttgaactgcttggtttgcagcctgtttggcttctgccaaggcagccgttgcatcagctaattggccttcataactagtcagcttgccttgtgcaacagctagctgagctttaacagtcgtaatcgttgcttgtgagtccgggttatctttggtttgctcggtcaatgtgttcagttgattctgtaaatctgtcatctgagcagaaagtgttttaacctgcgcagatgcttgatcaacagcagcctgcttagcattcacagctgcattggcggtgtcaaaagcggcttgcgcttgggccactgcagtttgggctgctggcaattttgcttgagccgcatcaaccttggttttggctgcgtcaacagcagcttgggcagctgaccgcttggcttgaagatcggtcaatgtttgagcattctcagtattgagcaaagccgtcaatttggcttcggcttctgccttgtctttttcagcagcggctttttcggcttctgctttggccttggcttcggcggctgccttaagggcggcttcgttatctttggtggtctgatcaatccccgttcctgggatggttacttgctgtccagcgccggaatttccagttgtgccagcgccgccaacggttgtgtatttcacctcagcctgttgtgccggggacgccactgccggcttggtcggattcagattaaacgtctgattcgtgccatcagcattttgcgtcgttacggttgcgttgtcgccactgccttgcagagaaagcttagcgccagcataaatcaagttcacgttagcaatgcggttaatggctgccaaacgatcaactgaggttgtgaaacctgtatgattcagcgcctcgctgatcgtcgaaagtgtgtcaccccactgaatatcataaaccgtgctattcgacgccttaatctgcgcctcaatctgactgactgggcgcagggtccaaactcgtccattatttgtctgtgattgttgcgaggttgctggttgatcacttgcatgcacaacctggccactagtcgccaaactaatgcctgctgtccccaatgcaaaagcggtcaaaccaatggccaaccaaccatgatgtttgctgtgaaccaaggtgaccttgtgttccttatctgtaagtactgaccaaagctgtcgtctcattgctctcatcgttactcctccacgttcttttatgagattacaaatgttattatacttcgttattaacaaagcttgtatttattaccccaaatcaaagcgtattctcataactttcttttttattgcagcgtcacctttttgaattgatccgtaaacgtgaattgtacttcccaatttgaacaaaaccatttgtcgaagcaactaaagccgtcttttataaccttaacctaccgtttcgtcacacgaccaagttcctgcgatatccttaaaaattcagtccaaagctgcacgacaaactgcgataaggtaacatacaataacagtatgcttttgcaaactcattttggaaacgaggccactcatgaaacatcgcaaccgtttattttggctgattatgcttgtggctgggatctttttgatctatagcactgaaagtccggtgccgatcgctgctcgcaacaccgtcaagcaaggcattagcaatgtctggaccgccacaactgataccgtcagcacttggctaaacggcggtccgcgatctgtcgcaaaaaatggtgcgtcaattgccagcaccgcgccaagtcaagcgagtcaggtaccttcagccacaccgagtcaagcggtcgatgccacaccagccttgagtattgtccaaaggcaccaacttcgaagtgtctattactaccattttgatgacaacttgccacagtctgaacacgatgtctttttaaaagccgtcaaagcgtataacgcaacgggcatcgtcaaactggttgccggtcaaggtaagaaatccgataaccagatcacgttttccagttataaaaaagaaatgtcagcagaaagttttggctcaacggaactcggtgctggcggcccgacaattattgttgaaacctatggcagccaagtcaccgtcatcaaccacgcccgcgccagtctgaatctttcttatcctttacaatcggtcaacgatgcagtcgcgatgcacgagctcggccatgcgttgggactcgatcacagtcaatcaaaagcatccgttatgtatccaattacacaaggggttagtcagttgtcagcaggcgatattgcgggactgagggcaatttatggcagtcgataaaactattttatttgaaacagtcaatcttggtactatctgcttttttgtaaaaattgcgttactcaaatcagcatcattatttttaaatgggaaatcattaaatactaccaaaaacctcgggcaaaatttgaaaattttgcccgaggtttttattatttgtcaaactaattccccttaccaaacggccacttgaatgacgttgataccttttctgcgcgcttgctgcaacaccgcttcatctgcaaaactatctgtgattaaaatatcaaccttgccaagatcagcaatgcgatactgctgggtaacaccgatttttcgataatctgctaggcagatgacacattttttcgcttttgtgaccatcattgaatcgatcgctgccgcctctgcattacttgaagttaggccaccgtcaaccgagataccatcacagccaatcacggtgacatcggctatccttgacgacaaaaagttcagcgtttcactgccagccagcacacttttctttgtactgaccctaccgcctgtaatcataaccttagtgccctcatgccgcgcacaagcggttgcacacggattgttggtgataacggtcactggtattttagccagttcattgatgacttgcagacacaatgaattggcgttcatgaaaagcgtgctgtaccgcgcaatgtaatggggaacagccgccgcaatcctttgggcaatcaccgccaaggttctctgctcacccccgccttgtccggcaatcgcttcaacaagaccgttgtgccatttaacccgccccatggcatgcaatattttcaggtcccgcctgatcgtgatttcggaaaccttgagccgaagtgccaatcctttcacagttgcaatgccgtgccgatcaaccagtcgttcaatgtcagctcgccgcgcttgaacgttggccagtgaatttttcattaagcttgctcctatgttgtgactattgaagttcctgccaaattggtaacccaccacaattgtttgcatgtttgattgccaaataccctaaaaatgtgcaatcccactttagactcaagtcacttttcgcttcaacgccatccgactcgttgtctatcaaaaccagcctttcactttcaaaaaactgaaaaataatcataaaacctgcaaatgatcttataccgcaattgtgttaactaggacggtcagcgtacacttttgtatgttaatcgtaacgattactattttcaacttcgaaaggatgtgctttttatgtctagttcctcgcatctgccactcacaagtaccctcataattgtagctgcccttgccggtagtggtattgctaccagtgcgctggtcacgttgccggctactgtcaacgcagccagtgacgctgacgcaacgccggtttacactgacttttcaacttttaagccaatcgccggccccatcacggtggtcacccccggcgcaacgccaacggctccgccagaaaaaatcagcgccaatggccatgattatttttataattatacgtccggaaaacggttgctctacttaccgattgcgcaagcctatcagccaaacttagcgcacatcaaatcactcgttgacgccgtcctccaacaaaaaggtagtcagcatgatgatacagtcgctcaaattgccgcatctgatcttgccaaggccatccaagccgactcagtgctccggcccgataacactgcgaataacaaagccttcacggacgccggattagtagctaaaggcggttcggtcgaaacatttaatcccgaccctagtgccgtgaagtggacagatgaagtggtggcgaatcgcatcaccgcctccttccccaaaggcgcaaccagttacggcctcgcaattggtcggctgccaagtggcgaatttgtcgcctacatcaactacgcagcaaaacctaccgtctcgagtcaggacacctacaccgtttcctacaaaaccctcgatggcaagtcgctcaagccagacgatcaagtagccagtgacaaaatcgccgtcctgccatttccagacttttcatacatctactggaaaaaagacgatgctgcccacaccgtcaccatgtactatcaacctgccgatggcgcctatcaaccagagatgagcgatgtcaccgacaccttttaccggctactaaacaaggagcgagccaacaaaggtttagccccactcaatctagacccgcagctccaaaacgccgcgcaacaaacggccagcgccgacgctaatcaactggccaacccgcaaaatccacgaaccgtcacaccagcagatcggtcagcccctgacacaaacctcatcacactatcgagtgacaccattcccttcgaacacgacgaaggcgaaggtgcagaagatttagtcgcaaccggcatcctgcaactcgatgatcgtccgggcacactcaacctagacgatctctatcaaccagacgtaaccgcagtcggttttggtgcgacgatgggccaagacgggcatatgtactacaccattcgactctcggagaagaaaaactcgtcaacgaatgaaaattcaactgatgatccctcacagtcagcttctgatcctgccacaaagaacgatcacacagatgctcctacaacggctgacaaacaagcggatgctccgagctcaccaacaccccaaaagacgaatgcgactccttcagctgataacgccaaacataaagagcagaacacttccaaagatttacctgagaccggtaatcgcgttttcgaaaaaggcggcattgtaggcttcctaatgttgctagcgacattggggattgggatggttcagaagctgcgatcaaagcggttttaattctggcatcagtcagtaaacaattctctcaaaatggactttttatttttagtacggatgcattagcgacttagcccgttcatgtataatagcctctggaaagtcattactttggaggtctattatgcaaaaaacattcattgctgtttgtacgctttttcttggattaggattggtcgggtgtggtcatcagcaacaggcaagcccttcaagcagttcaaagaaaactagtcagcagacttcaagcaggcaggcttcgcaatcatcctcccgctcaagcaagatcgcttcgagtagcagcgatgccagccactcaaccaccaagcaacccctctggtctaacgccaaaagcgcaaagctagctactttcatggccagctggagcaaaacaatgggtcagcaatacgaaagttactggcaagggcacagtgttgatatgtacgggttgaagattcccgatgaattaggtcaagctggcaccaaccaacccggctccatggcaatggcagttggtgataaggcggtcacctgggcacttagcaccaatggcgaaagcaatgccgaatatacaattgtcgcaatctattcagatgcggcccacgaaccttatctagggaaacatgtttatctttttacgttacacaatgatcagccagaggtgctcgtgactcagcagaatcagggtaatgacaataactggttgtattttagtgagacgcagaatcaggagttgcggctgggatttgcgaagattgttcagggtgattaatggtttagcgatgaaggcacaatatattttatgaaaaatggaaagccgtttcaaatcaattcgctattcattatcatcaaagcacagctagttcctactacacctttacaaacgctgtctatgttaattcatacctgatcgacggactaaatcaatcgccgcatcacatgtagctgcgaattcaatcccgtgcgcatatttattagacttttgataagcaatccataatttctgaagactttggcttgttttagtgctattaatacggaaatataggttcccaattgatcagtcgtttctcgtttggcagaagttgcttgtatcgccttacttaatacatcaaaccttatttccgccttatcctgattattgagcaaatataaatcgtaaaaatccttcaatcgtgtattcgtctcagcacggctaatgattgtctctaacttttcggcaataatggtttcaaccgtatatgccatgattggaacagtccgattttcaagtatcattttgtgtccatattgaattgcacgctcagtaatgacgtccccagtcgacacatctattttaacatcaactcgcgtggaatagagttgagcacgaatatgaatccggtaaccagaatactcgtcatcattcctaatctccccgattttcacaaccgataagttaatgatgtcgttcggtaacttaatatcacaaatttcttgaaacacacttttcatttttccttccgttactggtaagccaacaattgatgtgtccatatcacgggttgatcgagtatcagttccaatcagtgatgcaatcaagaatccgccctttaaaaccagattatctttgtaacgagaattcgaggttcggtcaatcaggtcgtctaaaatgatctcctgtaacataatctgtggcgaaattcttctttcctttgccaactttctgatgttagccaaaaactgcttttggtcaacaagccccagtttcatagcagaacctccatgtacattctaatttcttcctcaactttgaatgttcttgcgtaagccatcaacttacggagattcttttctttctgatgggcataactattcatagcttgtttaattgtctcagcatcagacctatcgcgtgttcgtagaatatcacacaaagtgcgctcaatgtcataaactttaactagatgtccccctggagtttgagttgacgctataccaatttcataaagttcctttttctgtcgatatatcttaactggtgcatttgttttagtactatacgcgtaaggcaacggaaagttcatttcgtaaatgctcggtgttcgatcgatcattccataaaggaataaagctgtgtccttgaaaaaaatccctttagacagactgtattgcaatgcagcaatatcgtcaccaaactcaaatggatcaatataaacacccggtgccaatctttcaagcagaccatgagcatacatattacgcagtactctaggagagatttccattgagttaacttccttagacgtaatttgaccaccattttcattcaagtatttaatgatttcatcttgttgactcatttagatcacctcatggaaaaatccgttttgtactcatattataccatccgttgagtataaagcggataagtcgtctgcattttggctagaaacattttcttacagttttatacattccactattagcacgtaagcaagtcaaatctaaaagcagttgcatatattccactcaattcacattttccacttgcattaagcaaacatatgttcgataatgattccgaggtgattaatatgattgaaaaacttgaagattatcaatttccactgcatggagaagcagcagcaagctaccttgatttagttattcagcaacgaactgggcgaaaaaccaaaagccactcgatcgttaacgcaaatctcacactagcttcgtcgaaggacgttgagaatatcatcaatgcgattcaacatccaatcggcattgctgattgcacgaggtaatcgcaatgacacaatttgaatatccgttagtcggttacgaagctcaagccgctgctcaacagcgcatttttgaacgctataaggcacagatccatttctgtattattgatcctgacaagttcaaaattgaatcagaagaacgcatgcaagcgctagttgacgactatgcgccactttttaccgagatgaattttgaacaaaacatcgaggatagtggtattgatccggatgccattcatgtcgaagttaccgatccaaacggcaatgaaatgaccgatgcaggagacgcgcttcgaaaattgacacgagggttgcacttggatcttggcttttatccagcgcgaaattctccgatgagttccggaaagctcgtagttaaagattcaccgcgtacgcatcgaattgcgtttgagtttagtcatagcctcaaagacgagagatcagttacgcctaacccaacggattttgtgattcaaacttttcaggcgtggattgatgagattacaggaaacgaatcttcaaaaatgacaaagtaaaacaaacaatttaatctgctcgaaagtgtatatggggcgtccacaatgtgtggttgtctgtatttcctcgtcatcaaatagtttcatggtcactcctgcttttataccctcaattagctgacataatgtgcttaaaagctgaatatccaaatctgcatcattgctatacttaagtcatctcaattaagggaggtgattaatgatgcaacgccagttcgtttcatcgggccgaattcgcagcgttggttggtcagacaacacccttgaagtagagttcaaggacggtgctgtctaccaataccacggtgtgtctgaaagtgagtatcaagcgttcattcgctctggctccctaggttctgctctgtcgcgattagacaagatccatccatataacagcgtctaatctttcgaggtctctactggcgtgaacgcgtcggtggagactatttttataccgtcttgctcaatctcgatacgttggtatggattgccttgttcccgcaatatttccacaatgcgcatggtatgccgctcaagttatttgtttatttcgccgcctcttctttcgattttcgtaacgataaggctaaaatttttaccataggcatatgaaaaacttgtacaagtaccggtatttcagtcgcctgaagtttatattcgccactttctcgacgggtgtatttctcagtgccagacaaatgcaacgcctgagccattttcgttttagtgacacccatttttccccgagaaaacctgatcttttctaagtcaacttcaaacaacatatcttcaccacatttgcgaaataagcaactcattataagtgtcgcatattgcgcttttagcaaaatcaacaaaaagattgcgaaaatagaagagttggtttcgattacagcaaaagatgttatatttatattgcgtaaaatgcaaaggagctgaacttatggatactgatctactcaggcaaagactaattgatttaagagaagaaaaaaacttaagccaatcagaattagctcgtcaaatcggaatggacaatactgccattagcaaaatcgagagtagaacacgtaaggtttcagcggaagaattaaatcttttttccgagttttatgatgtgtccacagattacttgcttggtcgaagtaataaacgtcactattatgaattgacggcaaaagaccagaaggctattgatgaagaattggaagaaatagtcgaaggcctttcagataaaagcggtgtaagttttttgaaaaacaacactgaactttcggagcgagacagagagctcctaatcgtatcacttcgtcaatcgatagcgcttactcacgagatggcgaagaaaaagtttacgccaaaaaagtttcgaggttcagaatcggagaactagggggtagttcaaatgtcatacgattccgatagagtatttttaaagctaaaaatctcgtctctttgtatgccacacggtggatgtaagctgattcctgagacaacttttaagagagggtataatgaataaatcgtctctcaaaaggaaggaatttttacatgccaactcgttacgacaaagaattcaaacaaaacattatcaacctatataagcaaggcgaatcagctgcccaactggccagagaatatggcattggctattcaacagttcataagtggatccagggccaggccaaaactcaatccggtaaatcgccagacgaaatcaaagcgatggaaaagcgactggcttcgctgtctgaggagaacgaaatcctaaaaaaagccctgggcttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgtggacttgaaacaacggattctgcggatctttgcggaatttaagcagcgatacggtgttatgaagatccaccatgaattgaatctggaacttcaaccactgcagcttcggtgcagtccacgacggatttcccggctcatgaaggaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtcatggctggtgttacttatcaaccatcatggacctgcactcacgacggattatcggctattcgttctcaaaaaagatggatactgatttagtcttaaagacccttgaaagcgcggttaaaaatcgaaccattactggggacctgattatccatacggatttaggatcacagtataccagcgatgattacaatcaacgtttaactgaactacatatccgccactcatacagccgtaagggttgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgacttaatgctttccagggttcaaataagttattaatcgcaattgatgatttatttgagctgtggaaggtaaacgcggttctgaatgtctcttaaaatctgtctcaaatattgacttcaatccacgggtgccgtggggattggctcgacattttccagacacagtagttgttccagtcgatttgggcgaagacattatgggatacagcctaacatccagacgcatagctgtcgtaaatttaaacgagaaaatggacgagaaagaatcaaatagtgtgctagcacacgaacttgggcatgtgtttttgactagggagaccagaaccaactacttttataaaggtgctagcgaggcagcagtcgattccgctgaattcattgcaaactactttatgtttcaatttatgtttggcaatcacagtcagattaatcccatgaatcgtaaagctgtcctctacgattatggtcttccagactggatgagtaggtacttcaaattaatagatacagaagatatggggggtaaaatggaaaaaaagcgaaattggttgttatggcgattggctgctgggttagttatacttctgctcggaacagggacttttatcgctatccgcagtgcaaatgcggataataaacagagcaaagttagcgaggacaagggtcttgataaagaaatcgacaaggcagcggacaaagatattgagaatggcactgaaagtaataaagcagaaagccaatcgcgtgtagttgctgaagggaaaagctctcagcaagccgcgagtgcatcaaaagaaactgagcgccaatcgagagctaatgctgaactagaatcaaaaaatactacggcaagctacgaggcttcagtgaaaacaaaatcaaccgaacatgtcgaaacaaatcacgtgtttggccccttcagcaaatcaaaattatctgagtatctctctgatataaaagaacctagtggcaattactatcttggttcagtaggtgttatgaaagttggggccggcgttgacgattctgacaatgtctcagtagtaaaaattgatttgcggaaatccccttctgatcctgatttagattcatatcatttacaggaacttgcagcggactggatgccatctgatgcaacgcaaaccagcaatttttcgtctactgaattttcttttcactcaaattcaactgatcacgattacaaagtcgaatacacccttaattcaaaacaacaggtaacctttgtttatgtacgacagggttagtttctgtgaaatgctcattcatcgtgcaactaacaccaaacaacaaaccttttgggacctttattttcacgcaaaacaaaaaacctttcgcggaaagctaaggctagacataataagcgggtatcttttaacaatttggaggatgaaaaatgacaacaattgaagaaaaaattctgccttctcttaaggaagcggatgcactgccttttttgttcgttggttctggattcaccaaaagatacttgggactacccacatgggaaaacctaattgaccacattgctgacttgacatatgggaataagttccagttggcagcgacaaaaaatgaagcaaataagctctatgacaaatctagaaattacaacgcatacatgacttatcttacggatttagtttccaatgacttagataaagtttggtatacaaattctagattcgcagattcacggcagaagtttggacaactagctacagacgaacaagttccgccgttaaaaattgaaatagcaaagtacattaaatcattcgacccttcacacattcttaatgataggcaggatgagttctccgctttaaagaacttagcggaacgatcagttgcaggtgtaattacaacaaactatgacactttaatagaaagtgcttttaagtttgaaacctactcatctcaagaagaacttctttttcatacaaaatatgatttaggcgaagtatataaaatacacgggagtgttaacttccccaagaccattatgataaatagtcgcgactaccaagagattaacgaaaagcataaatatatctctgcaaaacttttgaccattttcgttgaacaccccatcttttttttgggatattctttggaagatgaagacatacgcaacatactcttcgatatccaaatgggactaacacctgaacagttagaaattatcgaaaaacgtcttttctttgttagttggcgaaagggaatacgagacccagaagttaccacattcaccatatcttttgaacaggggcactcgttaactatcggccgtattacgcttgatgactataatgatctatactctgtcatcggaaaatcatcaaccaaatatccggttaagttgcttcgttatgcaaaacgcgacttatatcaatttgctctaacaactcaaccatctaagaaagtggttttatcagttccagacgaagatatgaacccagagtctcttaaaaatgttgaatttgtgtacggttttggaattattgaaagagctgaaaagggttacaagtctgttgactcaacagagttgttcagggatatagtttttgacgatcaacattttgtcactgaaatgctagtaaaagaggcgctaccaattgccctaagacagtcttctggatttatacctattcgcaagtacgttagaaacttagacccctcaacgcttccagaaattgttataaataatcttcaccgattcgctaaatatggggattttttatcaatacgattaaactcacaaagacgaaaccagtttataaggccacaagatgcacttattcacccaggtgaagactttactcgtcttgctttagtcagatgggacaaacaaaatatccatttgcttcttgattttttaaaagatcacttaaattctaatcctcaaaaattccaaaccactactgggattcgaagactcattagaatctatgattttatccagtacacataaaaaagaggccttagacttagtcgatcagaaagactcaacacatcaagcggacctcttttgcatatctttattttaccacacacaccttcaaattcaataagcctagattttttaggcttttattttcacccataaaacgaacgtacgtttgtcaagggcggtttaaaaatatcggaaaatggcgattaaaaatgtaggtttttggcggctagttttgttgttttagtcgataggatttaccggtaatcttgatgacatgggcacgatgaaccaagcgatctagaatagcagaggtcaccgttgggttttggaagatctcaacccaagttgacagttcactgttactggtgatgatggtggaatgcacttcatagcgagcgttgatgagctgaaacaaaagattcgcctcatcatggtcaatcggcaagtaaccgatctcgtcaatgatcaaaagatcgtaacgggcataacgtcgaatacaacggtccaacgttcctttcttgtaggctgcccctaagcgtaagagcagttcgtgacagttaacgaaaagtgttcgtttgttctgctggcaagcagcgattccgaccccgattgccaaatgtgtcttaccaacaccggggctgccgatgaagatcaagttctcatgcttttctagaaaagctaagtcttgaaagctcatcaccagctggcgattcacgcttggttgaaaatcaaagtcaaaagccttaagcagtttaacctgcgggaaacgcgctcgtttaatgatccggtcgacatgctcaccctgacgccaatcaagctcagctttggtcagattaagcattgcttctgtgaatgagagttgtttgccattaatctggtcaagatactccggcaagtaagcactcattttcgttaaacgcaactgctccagattgttcatcagttcttgaaatctgcttgtcatttggccacctcacacctcatcgtactgtgaaaggcgttccgtaatgtaagccgtgatgtcttcatctgggcgtcctctcatcaaatccgacttaagaatttgtacctgatcctcaagggcgtaattaaactgatgtgttgttatttcgtgcgcacgaatcaactctccgttataatagattttgatatgccgctcatcatcggtcagctcaatgccaactgtgcgaccaatgtagcgcggatcaacggagtacttgcatttgcggaagataaccatcgattccgtcgagacgacacgcgtaatgtcttcttcgaaatagggcttgagtaggttgcttggcaatggatgcaggtactctttttcttcgtcctcccacttgacgtaaggaacttcagcggttgcttgggaaacttcgtgattaagatcgtcgcagagttcattaatgatctggatcagatcaacgccatctgagaattcatgattataagttcgtaggcacttggtggtgcgcgctagggcctcaacggatcccttcgtctgtgggcgatatggccggcaggtaattggtttatagccggcatcttgactaaattgtctgaaccgcccattgaacaccgggtgtccaaacgtcgatttactgtggtcaacgacctgcttcatgttgtcgaaccaaacctcggtagggacaccgccagtggcttcaaatgcttcggtcaggcactgaaagagcgtatcctgactgcgttcaaacgttaggctgaggtacttgagctttgaataaggcaaaacatacagaaagatgttaaagcgataagcaacaccttcgtgactgtaaagtgttagctcttctttccaactcaacctgtgcggataaaccagcagtgtgttcaacgcgaatggtggccttgtgaatccgattctgcttaatcgtccggcagtaatcacgaacgattgaatattttcctgtgaagccttttctacgccctgtcaagtttaaatcccgctatgtcaatgaatttgattttgaatatcgaaacttcttagccacaggatgctgaatccaatcttaaattctgatctaaaatatccttaaatcatatagtctgacaccccaaataaacctgcatgctttccaaaatttgtgcagatatgtacagtaagtgtatcgagtcagtttatcttgaacaagcgagttcgtatgagtataactgattcgtgtttacaaggtagtgaatcgtttttagtaggcgatccatgcaggcgacaagcagcggcttcctccgggaagctgttgcttgtcgttttgcataaaagtcacggatatgacttggctgtgctcctgagccaatcatatttataactgtccaatacagtagctttctagtgtgagcattgccatgcttggtgatcttcctttgtgccgtatagttccctgattgtatctcttgcaaatcaagaccaataaagctattgagtttcgctctggttttaaaccgccgaatatcccccagctctgcaaccaaacgtacagcggtgttttccgcgatgtttggaatgctcaggaggataacgtactccggtgttctttctgccaagctgaccatggcttgtacggtttcttcacgttcgctaagcaactttaacgccttttgagtctcatgctttacagcttggacaacgaacgagttgccgctaacagctggatatgacctggctcgagatctccatagtgcacgtgctaaattgctggatctgaccgctcccaccccctttaagtgcatatccagaatctgcgtctttatattctcaaaacttaatccagtcagttctgccgggtgagaaaaaagagttagcgtgtgtaaggctgatggctttctcaaatcaagttcttcctcaatccctggaaatgagagctgtatgagtcgatgtatccgattcttggtccgttttaagtcctccgtttgctgatcgtagtatcgactaatatccatcaattcgcgatatacagggtcatagaagcttggtttgaacggcttggggtgtttggcaaactcagttattgctagcccgcgggcatcacgtacatcgttcttccttgttcttgagccatcgtctaaccttttcttagcgacgagtggattaagaatatgatacgtaatgctttcatccagtaggtatcgctctaatcgacgtgagtacaccccagtcgcctcgaacaccacttccgcaccgccatatgagtcaatgatagccttaagactcgtgaatccaatcatatctagcgtgatatccccctcgtaaacagttttagcatcaatggctactgacagtttagccgttgattttgagacatctataccgataatttttcgcattgttacactacctttctgaagcaccatcactaaaaatcttagtaatcaagttttcaaaacgcggtctctcggaccaatctactttgagcgaatttgctaagacaaatgaagtagccactttctactacggcttcaaagagccaaaaggcaacccgcggcttctgcttcaataccactataaagtaatagaggcgtacatggaccccgtcgggtatcatgtacgcctttaagcttagtggatttcttctgaataaatttgaagatcgccatcgccgagcaattgtcctctagcttggccttgatcacgtgacgatagttgtccaacaaactgggacgatgcttcttagctgaacctttgcactgcgcatcttgattaagctcggtaaaggcttgtttcaccgttcggtagtcggcaccatattggcggacaatggcggcgaagttgggttttaaatcatcatgcataaattgtttcactccttctcgaatatcacgtctcacatcaataacctcctggttaggatgtgattcatggtatcaaaaaaaatgtaggaaaaccgacaatttctgtcccccattttcctacattttataaccgccatttacagcctagcttgtctttagcttactagcttttaaaagggaatgaaagcccttttatttggtttgcactcaagtttaggcgcataagttctttttcatagaaaatagcggcgaataattctgacggccagcaggtcatggctggaattattcgccgctttcggctggcatgctgttggtatagcgcacgcggcgccactacggctcaattaatttaattgctcgaatttcatgtaatccaagatcaatgggatctgaaggattatctggcttaatcatgaacaaagtctcatcccagccatctaactcgttttcaatttcttgaacaattgcctgaatttgtcgcccatttgtcaacgtaaacaaaacatgtttctcgcgataagtgtcaaacaacttctgataactcatggtctgaactaacatgccttcaccttctctctagcttggtttcaatggtataatatgcgcgcctgtcttactaaaagaaacttgagcacaccaaagatgagagtgctaatttaaggctgtgatcgtcttaatgtcatgcatccaaacttcaccgggaccgtcctttttgaatggtattgtcatgaaaagaacatcgttccaaccgtcaagctggttttcgatttcttcgacatagaacctttgcgtatgcccatttttaaaaacaatttgaacatctcgatcgcgatacttctcaagaatctgcacaaagctcaattcagtaggattcattcttctcgcctcctcatctttatgatttcctggtcagcgaatgtaagttattttctaagatcatctttgagcgccaatatacgttcgatatttgccattctgaggtgttctggcaacatcttgtctatctcggctggagtaaagaattgttcttcttcatcctttagtgctctttgagtagctcgataacttttctggtcaattcgcggggttgtactataaattttgccaaccgtcgaagttaaagtgttacgttttacagaaagctcatcatcagaatacttgtcgaaatccgtcatcagtgaaaggtatgcctctctgtaacttcagagatcatcagccgtttttcggtgttcggaaataacctgaatgccatccgtgtccttgtaatacaacgtaagcgcaagcaacgcagcagaaaataaggttgtgataagttttagacagaatattaacacccaaaacactaataagaccaacagtagaaactgcagaaagaacaattttgattcttgcaacccttttccgctagatatccaaccgattgcccatcttattatgggcagtgtacgtgtaggttaattttccatacgattcacgaagctggaccatcaaattgcgtcgatggtgtttgtcattttctcccaagtcatatctatttcactatatattcaagtcccttgcctaatgcatcgcggcttgcatcaagatcaactacttgattgctacctggcgcataaagactaccagaccacaaataatgttctttgaaataattgttcaacatcatttcaaaatcaccggtactcgattcagaatgctgacctggttccaaatatctccagccgtcgattgcttcataggcaaagctatcaattgcaataccagcaagcaagcttcagactactaaaacgttcgttacgaaccacacgtagatggcgacatgtggcctgaagcaacccattacttgctttgttttttgcttttattgcttcttgttcagcttttggatcagtggctttccaatttcctcccatgttagaatccggataacgaaagcctgattgctcctcaccaaaataacctattttgagaaaagccgggagaacctcaaactttattccgtctgagaactgaattttcacaacctaaccatcagctcaaatgtcgctcgttggataactattattaattgcttcccttaacgcttgtaacagacgggacttgtccatctcctcttgccttctgaaagtggtcaaactcactctcgggcaaacagtacaacacatcaacatcacccgtctgcaccgcagtactccgcccgtacgaaccgacatatagagaatgttcgttctcgctctcagagttccaaaaagctcgatttcccgcctttgtgattgtatgatatcgacgtgtaatgatctcactcacgtaaagactgcagaagtacatctttatgcttttcaacatagctcgccataataatcctccactccaaaatcccttttattccgagacatgtttttctctgaaaatatcaaacaacggcactggttgaaatttgtttggcgatatttccacgggctcttcatctaagtcaaacagtgtcaattcttcagatccgtgtacttttggttggccatcgacagaaggtccgttagtccttatcgcatcgaaagtatactcagtacgctgaatcttccgaattccccgtttcacgggaagcaaggtccattcactgaagatgatatcatctccattcttgttcttgccggttagagcatctccttgaacaaggttagcactcaaaattgttaatgcgctcttaacaaccttcttgttctctgatgcctgatatttgcccatctgacgcagatactcctgatagaacactcggtacatgtgcattaccaatagctcagtattatctacgagaagctcaatgccgtaaagtgaggttaatgcaatcaatgcattctgttcaaaatcctcaatggaatcacccacgctgcttgctagattgagttttcgggagagtacctccgtcaagaaggcgccctcaccagctgcgggctctaaaaacgtagcggtaagtgaatttaaagcagcatttatctcaggctgatcaagcatcgtcatcactacttgatgcggcgtaaaaacctctccatgttctctaacccgacggtttgactttattaacctttcctttgacatcaattcatcacctggacattattgctaatgaattcttgctcagcttgactcagttcatactttaaatatagttgcttatcaatcccctcgacggaggcactccactcaacgtcggaggcactggtgaaatcctgtaggggaatctcagcccacaccgagttcggattatgctgtgtaaccttccttaccgataaaagagctctagcaaatttggtcttaaggtactttgctagattttgtgcctgactcttgtcagaaaaggcaccgatgctaataaaggtatctgtacaaatttcacccggatttagaacaacagtctctgtcagccgttcaccaaagtcacccgatccattggcttcggtaattgctagattaaaagtatctatgcaattatttggaattaaatatcctctcaaaatgagcttgtacactcgcttagcctgttttcttcccaatatacgaagatatggtttccgcttcgtgtcatctgtcaaaaaagcaaatgctagcttttcaaaagcatttgacgcaaccatattaccagtccccacgccaatcatcttcttagcactcggattttcctcaaaaaatagttctgagaatctatactggccacgaggcgcaacaattgtgctaagcgaaacaaagtctgttcgacttctcacccgttcaataattgacttcacctctgaatacgggacaaattgctcaattgcgccaaaatccatatcggtgtcacgtaatgtgatcgccaatccacctttgatatctgtgtttggaaaaatatttgcacttttcggctcatatgcaaccactctcagatgcgggtcgcttaacatggtagtattccaagccttcggagtctgaccagcattaaaaagaaagcgtgcgggtgtgattaaaaccactttaggcgccaacgcataggccatatccataaacaaatgatagattggttcggcacgtgcggtgtctccgttgccttcttgctggtacggcgggttcccaatcaccacatcaaacttcatatacttgaacgcctccttaatcttcttcacgccagcatcaatactctgccgtgctgtctcgacaatatcatctacatacacaacgtgcgttttatggtttctataacctgtcaacgtacgttctgcaatcgtctttgccattggcgtcttagctaccgcaaagacgttttgatcaagaatgttggcccacagatcttccaagtcttgcacagagaacttacccgcagtaatttcatttaacttctgaaattcttggtaatacaaagacgtcgccacatacagcgggtacaacccagtctttgagtttatttcgagattatgggcatcattgttgaaaatctgatcagtgagatccgttgtgcgccattcggcaatctgtttgccatcctttgtcgaattctgatatgcgtcatcaaagaaacagtatccgccaatcgtcttacccagttgcatgttaaccactcgccacggcgtgagaactgtttctttatctgggttcttgaacgtactgaacacatcggcaatttgtaaggtccgttcaatcgggtccagctgatccaattccttcacacggtggcgaattatgcgtcctgcctcgacgaatacttcaggatcataatacttggaaatctgacggaatttatctttggtaatcccttgaggcatgaattccgaccaagactgagcatcaaccaaatctacaaacttgttgatgtcaacgttctggtcaatatcgatatccatcccgtaaatcatcatcggaatgcgaatggagataccacgaagcaccgagatcatcgacttacgttgcttcttgagcgtattcttgcgatcgatatcagcctgttcctccggcgtccgctctttcttcggtttcttctcagctcgaatagccttctcatactgttcgtcatccaagccctgatggttcacgtcaatcgtatccggcttcttcttggccttagtctggccgacaatcgcctttatgtcgttaaacatttcaaggtcagaattggtcaatttcaacagctcatcattgtacagagaatcgtcatcaaaaccagattgcaccgctttttcagcatagactttcttcagctgcgtcaagagggtatcaacttggtacgcctgcatgccctggccttcttcgcctataattgggaggaagttcaggagctcaccaagttttgcccgctgatcagaagtttgtaacttgccgacaccggtgctcatctgacgagaggctgccatcactttcaaagcacggtctggtgcaaagtcaaagatatagcagttagtcttacggccaaactcttcatcttcataaggtgtctgggcacgaaaagcagcctgcaagtactgcatggcactattggtattcgaaaggaaaagtacgcctgtccacggcttaatcgtgacaccagtggtcatcttgcgaacagtcaacgtaatggtgtgcgtacgggccgggtgatccgtaatggcatcatttacccgcttcaaatccgaatcggtagccgtaaccacattgtcgctcgtatctttgtcaacgatattcacgacgttatagaagccaaaaactggatggttctctagcgccgtcttcatcgccttggccgacttcacagacggcatcaaccaaagtgtgtgacgcagattattccggaattccagagtggagaacggatagttggaacgttcatcacgactagagatattgtctagaaatctgttcaccttatcagcatagacaaaatttcccgtctcatcgtcaaccttaaagaattcgcggaagttgaaggacttatcatcatcaagaaattccggacttttgaaccgattcttgatttcaaaagtgtacatcgaaacagacggcaacccgacataaggattgcgttcaccattaggatgctcactattccaagaatacttggcctgttgctccatcacataatcccaggtatagacttcgtccgcatcatactgatcgagtagattgaatggtgtcccagatagttccagcacacgggtgtacttcggcgtgacaacaccatcgatgacctgttgcgcaagatctgtctgggtgccttcatgcgcttcatcgatgatgacaaggtcccattgagtatctttcactagctggttcttgtcagagactgtgccaccaaaagccttggagccacgaagatcctggatactagcaaagtagacgtacttatccgcttcacgttgtagtgcttctagagataaatcttggtcgcgcttagaaccatatttgtaacctgactcaggcatgcctatcttctcgaagtcatcaaaccagccctctgcgaccacggggcggtgcgtcataatcaagactttggcgtagttcttctttttgatcagtttcagtgcagacagggtcttgccaaaacgcatcttcgcgttccacagcattttgtacttggtcttgaaggtcttagccgttttatcgaccgcgtcttgttgttccgggcgcagctcaatctttcccgttgcctgaaccggcccatcgattgactcgcgaccattcttgacggcggcaatcgcctgcttcacttggtcggcgctaacctgaaaccactcttttgccccttgcttctcaaatgctgcatcacgcttgaaacccgactttaacaagacacggtgaacatcatgatcatcaaaccatgtatcagaaactttgcggtgcgcaagttcgacccagtcaagattgtatggtacaccagaagtcttcatgtattggctaatccgatgatgtgcctcacttcgaaggtaatcactgtttggcgaccaatccttctcgaggtcctgactagctgtggtttcgcccaccttctcaaggccggtataacgtggccaattaccatccgaattatcacctgaaagcgagtagatcatatggcgttcagaagttgaatataaactgcgctgagccggttcaacaaacggctggacctcaccttcatagtcacaatatgttttagcgaaccagtacattaactgaatcacttgttgcaatgccgcaacaccgtctcgcttgtcatactgttctagtgtgtgagacgcttcattccccggttgcttgattgcgtacagcaaatctaccaactgctgatccaacaggtgatgatacttcactgtcttgagattttgcgcgaaggtcgcatcgttatccatgtaattctgatctaggacaaacttaacgacgttctctgcaatcttgcgtgcagaagttagttcggacgcatagtttcccattgcgtattcctgttcaaggaagtccgcagcgcggaagtagctcaagctgtcctcgctgccttgcaagaaatcaaagttgctgctcattagttaccctccaaataaagttacagaaagtaggaacaatatccatttcgcataaaccatactcaagtattgtctatctttatgcgccataatcactgaaaacatcaaacacttcagtggaaatttctggtttaagctcctggagcttaacttcatcaataattggtggcaacgctatcttcgctcttacaaacgatgaatcccagattgtattattagggttctttacagcattacatattttccctgaaaacgttaattctgagcctgacagtactgatagccgttgcaaccacacatccaaatattctaaatttggagtattctctagcttcgttgtgatcttagatactatctcggcggatttgctaggttcccgttgtccttttaggagtatcttgctaagtacgccgactcccggtgcgatagccttcggattcttgctcacgatgtctgctacaatacttatcaacggctcaatagattcctcaatcaaattttgttgatctaaccttttagcaaacgatgttaaagccttactgatgcttcctgaatttggaaatttttttgataaccaaagaatttccagcagatgtttttgtaatgttaactgataattaaccctacgatattttccatcccagaccttaggcattatgattggtactcttgaattccaatagaccttatccggtttaatagccgattcaataatatcggagacaagccctgttttcttagtattaaaatgcatattcaggtcagaaagtacatcggcaagcgcctttacaatcttctcagcaatttccttactatttgaaaaaattctataatcatcacgatatctaactacttgccaatctacgtcattcagatcctccaatttttccgaaagaagtaagtcggaatacccaaggacaatctcagcaatgaaattaaaaagttctccaccttgtggaattccatttgtttgattacactgaagcctttccactgtccaatccagcatatgtgcaaaagacttgtcattacgttttcccgtcgcctgctttgctgcatcttttccccgtatggcccaatcaatcgtatgcgtgtaaaccgaaccatagcagttggtaatgtccgttctaatgcagtacgcatactctagtgagtttacgattgaggtctgttctaactcttcccaccaatttaaaatagtctctgcggtatcacccttttttccagttgacttaacaggcagactaatacatctgattttcggattagactcgaacagttcaaatctatcaagtaatttctgccaattcccttcctcagttatttgctcaactaggtcagcatataagaacggatgtacaattttaacttctcgccaatcatatcctgcatccttgttcaaaataatagagtaatttgcgttttcggcggtcttaaggatattgccattaatcatcgacttgagttttccgcctgagacttttgaaaaggcaaaatcaagcactggctgaaagtcaaagtattccggtaataccatatttacatagctacttgattttaggaaaaaggctcgcgcttctgtagccgtcatttcaagtacactttttctttcagaggacattccagtcatcaccgccatcaatccgttttcactaattttaccacgtattatagttttataattagcaaaaaatccccgccagctcagccctcaatcggcccaaaattggcggggatattggcgggaaacgtaacaaattccccgccaatcgtatcctttgtatcttccgaaagtgctgttaaatcagcattccgggttcaattaacatgtaccttctattcccactcaatcgttgccggcggcttggaagtaatatcataaaccacccgattaacattcttaacttcattcacaatccggcttgagatttcctgtaggacatcccagttgatccgggcaaagtcggcggtcatgccgtcaattgaggtgatggcgcggatgccaatggtgtagtcgtaggttcggccatcgcccatgacaccgacggatcggaagcctggtaagacggtaaagtattgccaaatgtccttgtccaagccatgcttagcgatttcttcacggaggatataatcggaatcgcgaacgatttcgagtttatcttcggtgacttcgccgatgacgcggatgccgaggcctgggccagggaatggttgacgccagacgagggcgtggggcatgccgagtttttcgccgagttcgcggacttcatctttgaagagcttgttcagaggttcgattagcttgaacttgaggtcttctggcaggccgccaacattgtggtgagacttgatggtctgggcggtgtcggtaccggattcaaccacatcggtgtagagcgtgccttgggctaagaaatcgatgccgttgagcttggctgcttcttcattgaaaacttcgatgaagtcgcgaccgatgattttacgtttcttttcaggatcagtaacccctttgaggtcgccgaggaagcgatctttggcgttgaccttgatgatgttcagaccaaacttgcctttgaggctttccatgacttgatcagcttcgcccttacgcagcaagccgtgatcaacaaaaatactggtcagctgggtgccgatggctttgtgcaggagcacgccgactacagatgaatcaaccccgccagaaagaccgaggagaacgcgcttgtcgccgacttctgcccgaatcttgtcgatttgtttggtgatgaagtcgtccatgctccagttggcttcagccttgcagatgtcgaaggcaaaatggtggaggatttcatggccatattgcgtattttgaacttcagcatggaattgaataccgtagaatttacgatcatcgtcatccatggcactgattgggcagttgatgctggttgcggttcgccggaagccttctggtacgcgggtcacgaggtcgccgtggctcatccagacggtttgatcttttggcaaatcgcggaaaagcttggcgctgtcatcggtgacttcaatgtccgctttgccgtattcacggttgtcagccggttcaacatccccaccgagccgttgtgccatcagctgcatgccataacagacacccagaatcggaatgccgagcttgaaaagatcctcatcaacacctaacgcgccttcgtcatacacactgttagggccgcctgagaagataatgcctttaggcgcaatcttcttgacttccgctgccgtgatcgtatgaggctttaattcagagtaaatcccaaattcccggattcgccgggtgatcaattgattatactgactgccataatcgaggacgatgatcttgtcgtaatccttgttctggtcatttgccacagtccgccacactcccttgtttgaatgcactaattttacagagttttcacatgtcggtcaatcacgggtgagaagcctctcatctaagcgttgccagcgataagcttcagaaaagccaggcgtgtccgacactgctagccagctgtttttcaactgacttatcagccatattttaccattttcgcagcgaaacttggtcaatttcatgtcccgttgttttgtgcaaaataatatcagcacgatttttggttggcaggatgtactcattcaggttcttgaggttcacatcgcgccaaacttgccgcgccatcgcgaaggcatcggctcggtcgccaatcgcgtattgatagtaatagttgtttggatccgtgaaggccgtgtcgagcaggatgccgaaacgctccagataccattgttcaatgaggtcaggattggcatcaacgtaaatcgagaaatcaaagtagtcgctgacgtagattggctgcttgcttggcagctggagcacgttgatcccttcgacaatcagaatatctggtcgatcgatcagctcatattcgcctgggacaatgtcgtaaatctggtggctatactttggtgcacgcaaagcgccgctcgcatttttgacgttgttcatgaaatggattaaaagttccatatcatagctttcagggaagcctttacgatcaagaattccccggcgttctaactcagcattaggatataaaaaaccgtctgtcgtcatctgctgcacgcgtttttccggataagcccggctcagcaacagttgcagcaagcgcgcggtggtgcttttcccaactgccaccgatccggcaatgccaatgatgaatggtgtgtgcggatttcgttgcatccctaaaaagcggctcaaggtgaacatatcgccttgataatcctcatagcggatgtgaatcaggtgtcgcaatggtgagtagatcattttgacatcatcaagactgatttcatcattcaatgatcgcaactgcgccaactcttcatcagtgacattggtgaagttctgggaatggaattgcgaccattctgcacgatcaaatttatagtaattcatttcggattgcataacttaccgtttccttgcgtttaatgttctcattttagcatagaaagccccagttgttcggccaatccttttcttgacaacaaagaaaaaaatcttcacaatcaacctatcaaaacgacgcgatgccagctcgaacactgacggaggtgccagcaatgcttgaactagtcggcgagtttctcctttcctttttcattgaaccgattttagatggcgtaattgccccacttttagcgcccacttttaaacaagaaagttccttacgaactaattcaatcagactggtcatcacgctcatccttaatagcgcgattgcaggcggtggcggctggttgttgttcgaatccgcgacggcctcaccggtttctggggtggcgatcatcgtcggactaagcattttctcgcttggcttcgtcttaatcgtgcgtgctatcattaaatacggtgcttacatccgcaagttgcgtcatattcggacggccaagcgtgatgccgaaaagccttatcaggaactttaacattgagggagtacgcatttgcctaacatccaaggaggcacgctgaatgcttaaccaaattggaaaatttattttatcgattttgctggcccttttcctcgtgccaacattccgccgcagtccatccccgttttggtactgggcatggtatgtgttactggtcattttttgtgtcagtggcactggctttggtatctggctgcttgtcctcgcgcggtttcgcaccacggccggcattatcgtctttgttggcatcttattgatagtgttgatgccactcttcttaattcgcgcgaccacccaatttaatcggtatcgccatcgtagtcaaaaataggcaaacaaagagcgctcttcatcgagcgctttttgtttgccttcaattggtgccagtcatcacctagtcgtgcaaggtgaactgtaacttcatttttggcgctgctgccgccaccatttgacctaacaactcattgctgttggccatggcgatcgttgccatctgctcattggcagctgtcagatgatcggcaatatccttggcatctttgacagcttcatcagttgtgagctgcaagtgccggcaagcggcgactgttttttgttcaaaaacatcttcctgatctttaaataacgaaaagtcgtagtcaccaaacgttgctaacaggttgcttagccagtacattttcgtcacatcgaacttgtcgccggtttcgcggtatgctgctggtgtgtcattgacattagcgtaaaacggcacaacagcattaaaggtgttcgggccaaacgccaaccaatgaatgccggcaactgcagctggcacattgttgcgaatctgcaaaatgtgaagttcctgattacggttgatgccgattggccgataaagcttcttctgtgctggcgtgcctgtcgtgccgtaaacatcgtatggcgtattttcatagtgggaactttccacaaacttcacgtcttcgatgctgatttttttgctagtccggcaaatgaatggcagatcctgatcgatcggtgtcgtatcgaattcagggttgaagtacttctgaccgtaccaagcacgtgggttgttgtaacgggtatccttgatcgtagcggagccgaaaatgtggcgcaagttgtacccttccgcatctggattgagatgataggtttcaatcaggtcgcgcagatcggcactgctcatcgtgtcatcgctagcaaaatcgaaatcggtgatattgaagcggttcggcgccaccacataggcatcgtcgggaattcggatggctgcccaatgatgaccgccaatactttcaaagtaccaaacctcatctttgtcagcaaatgcgatcccgttgctttcgtatgtgccatattgttcaagcaaactgcccaagcgttgaaccccgtcccgcgcgctatgaatgtatggtagaacgatcgttggcatgtcttcttcgccaatccccgctgccaccagcggatcaacaccaaggacacggctattggttgtaatcgtttcggttgaggtcatggcaatattttcgctattaatccctgctgccgcccagataccgtggccatcttctgcttccggggtggccgtgtagcccaagggatcggccggcaaatcaatcgcgaacttgctgagcacggattgatagtgacgcggctgatcttcaggtttcacgtacacgaacttctgcggatgcaatggtgactcaccgtcttcgtttcgggcaatgatcgtggagccatcaattgaagctttcttgccaacaagcaccgtggtacatgaaccgacatatcgttttgccaaaataatcgtccttctttcaaaatgaatccgcatatttgcagcactgtgcgggagttgatttatggtttactttaccgcgcgaaaacaggtttgccaagcgtgcccgaaaacaagtaacaaaaatagccatccctaaagtttaaccgccttgggatggctatttgtaaattcagagccgctgttgacggcgttgttggttcatagaggctagcgactggaaaacggtagcctttttacagactcatttatcatgcattttaatggcgcgtctagtcaaactgttctggtctctggactgacgatcctttttaaacttttcaaaatccaagctttcaatccaacggcacctcgccgaagctagcattgattttccgatagtcggcgcgtcgttcatcgtaaccggctagcaagcgcttttcaaactcagattctgcttcgaccggcggcagtgggccgtcttctttgtggcgggctacaaaagttgcaaaggcggtgccgacttggaagcgttcgccagtggctagatgttcaccaattaactgaatgaaaacttccagtgaacggtgacccacgccgctgaccatgcacctaatgaccagtgcatcccccattttaaccggtgctgccagatgcaccatgtccaatgagccagtcgctaaaccacggcggccgagtcgttgtgcggcaattgagctgacgtcatcgatccaagtaaagatctgaccgccaaacaatgtctgatgcgcattcagcatacctggaaaaacacgataactagaaacagctaaggtgtcatgcattttgaccatctgtttacccccgctcgtacaagtcagccggtactttgtctaacaacggcgtcacatcaggactagccagcatggttagtcgatgcatggcccgggacgccaccgtgtacaacaactcacgttcatcctcttcatggtaattggccgcattgatttgccaaagcacaacggcatcgaattcgagccccttagccaaaaagcttggaacaacgatgacgccggctgcgagtcgttgattttcagacttgatcaaagttactttgatgccagccgccttcatttgttcataaatggcttctgcggcttccagcgttttcgcaatgaccgcagttgtctgcttcgcttcattgttaattttcaattgatcctgcaaagccgccatcaacccggcttcatctggacgaacgaccaactttggcaatggtccttggcgattgaacgccacgattttttgaccagatgtgagaatcgctttcgtaaagtcggtgacctgtttagtagaccgataactttgggttaactgcacgacgcgggttttttctggatcaaacagcttgctggtttcgttaatcagcgtccgcgaatcgtcttttgtgaaaatagcttgattgagatcgcctagcaacgtaaacttcgcccgcgggaagctgtccttaaggtaggcgagctggtatggtgtgtaatcttgaatttcatcaatgaagacataccgcatctcgcgttcaccatggcgaccagtgatcaaatcatacaagtgcagatatggcgttgcgtctgccattggtagttggcgttccttaaataaggtaataaaatgatcgacttctgcctgccagtcatcagcactaatgccctcggcttcgaggtcataaatagctggtacttcacgcaagaaactgacatactgcccacgaatgttaaggaagcgattacgaacgatgtcttgttgaatttcgttgaagccacgcatcaccagttggcgggcgaagaaccgatattcgtcatcactattcttaaactctttcgggccgtcttgctgcatggagcgaatctcttcaccgcttagattctcaacagcttcttgcacccactgcgatttcatttcggattcaattttccgattgagcattttgatcagccgttccttggtggcggtcaggcgattgcccatgtgataattttcgttgtaactataaaagatttcatgaatccgccggcgtgaaaagaacacctcaccacggaagcgaatgtcacggaagcgcaagcctgatttttcaagacttgtcgcatatttcttggctgtctcaaaaaagtctaagctgcctttgacacgtgcaattttcttttgaactggggttagttgttgctcgaactgagagaaaaggttttggacgtcaatgtgtggtaaccgtcgcgtgacatattggtaataagtgaactgcaccatgttctgttcgccaagttctggcaaaacattgctaatgtagtcagagaaaagttggttaggactgaacataatcacctgactactactcaggttgccccggtaccgataaagcagataagcgacccgctgcaacacggcactggttttcccggagccagctgcgccttgcacgaacaataagtccgctttggtatcacggataatctggttctgttcgcgctggatcgtggtcacaatcgtcttcatttgggtgtctgacttttcgcctaacacttccagcaacatctgatcgccgatggtttcggtagtatcgaacatcgtctgaattttgccgtttttaatgacaaattgacgcttcaaagaaaccgtgacctgttgcgggccatcaggcgtttgataggtaaccttgcccaaaccgccatcatagtaaattgagctgatcggcgcgcgccagtcgtagatgagaaacttaccagcttcattggtgaaggaacctaagccgatataaatcgtctccggcttttcccggccttcttggaaatcaatccgcgcaaaatacggattgcccatcaaccgcttaacagtcgcgagttgctgtgcgctttgcttccacgcattggttcgctcatcaagcacgcgttgctgttgctgaattgaggccgcagtttcaatcgtttcagcgtagtcggtgaagttcaaggaaaaatcattgaagaagttgtcactgatgttcttctcttcagactttgtcttagccatctcttttgaaagacggctttcggcaccggagagctccttcatgatgcctgtcaaatgtgtctgctcttttgcttgttcgttctcagccacgacgtcatcccctttaacggttactaaataatcgttataacatcttatcacttatgcgtctttgtagcaaaagagcttgagtagaagagactgtagcgcaatctgattctattttaggcgtcagaacaccgtaagtccgagttggctccgcggcgattcggggtggcgaccgcgaagctagagtggtgggcacgacttcgagccaacgcgcaagcccggcgcgccgtctcgaagctcggccttggtctaagcggagaaaaccgctccgcttagaccaatttcaccactgagtccatcgccgccccgccaattcttgcattctatcctcggaatggaatcatcttacccgtgataccgccattcaaattgtgggaagcttaaacaaaaatcatggccaccaaccaaacgtaaatcactattctcatagatagataggtgagatttaaagatcccagtgccaaggcggagcaatcgtaggccagatggggctcagccgtgcaaacaacacagcgaccgggcttggagctgatggtgttaggcgacttcgagcccgcaaagcccgcggtctcgaagcgccgtctccgctctagcttcgcgtcgccagccccagctggccggagattgcggagtttggcacggcagtaaacgttttaggctgctttattctaactacagtccgggattcttaaaattttccccgcaacaacggcgtccatgcttcaagcacgtacccaaccgccaagccaatcgcgacgcctaataatatttgcttgaatggcaagctaatcaaaagacctagcaacacgcatgtaccaacgatgacagagcgccgattgaagaacccctggccttgtttttttgatttattattttatgacatgatatttcctttcttttatccgcacttttcgttaccattgacccatctattatcgctgattggaggacattatggaatccatttcgttattaattgtgctcacagcggcgtttttgaccccgctgctgatggcacattttcatattaatagtatcccgactgctgttgcggaaattttggttggcattgtgctgggcaaaagtgtcttaggctgggtcaggactggtggtgagatgggctcgctgagtgagttgggtgtcaccattctgatttttctttccggcatggaaattgacttctcgctgttcaagccccagcccaaaacaactgatggacccaaacaaccaaacccggtcatgctagcaatcacgggatttttgaccgtcatcgtgcttagtctcgggtttagctacttcctgcaactcattcacttctttaactatccgatttttgctacgattttgttcaccaccatcgcgctgggtgtcgtgattgccgcgctgaaggaaaaagagttgctgcatcagccgattggccaaactattttattaattgccgcccttggtgaagtggtgccgttggtaagtttgacggtttactcagcgttagcaggcaaatcggatcgtaatttgtggctattattattgttgctgcttgccgccttattcctcctgagccggtttaagcgcatctacggcttccttgccaccattgataaaagtacaacgcagttagacattcggctggccttctttctggtttttgccttagtcactgtggcatcacgggtcggcgccgaatcaattctcggtgccttcctagctggcatggtgatgaaactgctcggtccccggcaagaaacgcaggataagttgacctcattaggttatgggttcttcattcctattttcttcattgtcaccggcgctaatcttgatctaaaagcactggttgccgacccaaaaagtctttcattaattccactagttctgatcggcttctttattgctaagattggcttgatcccagtgctgcgccggcggtttaagcctcaaaatgccttggctggcggtttcttgctgaccacgaccatcacgctggtcatcccgaccctgacagttggccgcaatctcgatattttatcagaccagcaatccggcgcgttcaccctcgccgctgtcattgcctgtgtcgccggcccaattctcttcaacacctttttccagccggaaccggaacattttaaaaagacaaaagtgaccttcatcggtggcaatctgctgacagtaccgattgcccaacatctcagtcctgatcgctatgaagtaaaactgttgacagataagcccgaaaattaccacacgtataattcagaaatcaacattgccttggcagcctataccgaatccgctttgaaagccgctgatgcttatgactgtgacatcatggttcttggcgatttcgatgcggacaccaactacgatctcgcgaccatggcattagccgaaaaagtgccacggatcattgcgcgattcgctccaaaagatgctaccagtgatcgctatgatcgcttgcgagcccaaggtgtcgaagtgtttaacgccttagaggcaaatgttgctttgttgcggagtctcattgaaacgccgtcaaccttgcaaattctagatgacaccgttgctggcatttacgaaatcacagtgcgcaactcgcgatttgctggccttgaattgaaaaatctgccatttattgatgacattaccgttagtcaaatctatcgcaataaaaagttcgtcgcaccgcatggcgacacccaaattcatctcggcgatcatttaatcttttccggtgacaaacacgtgattcgcgacattcgcgaacaagtcgagaaattgaattaaagctcaccgcatcgcgtggtacaatgagattattctaagaaaaaaaggtgatcaaatgaaacaagggacaacaatcctgaccttagacaatgggtatcatttgtggaccaacacacaaggtgaaggcgatatccatcttctttgcctgcatggcggccctggtggcactcatgagtattgggaaaactttggcgaagagctggccgatcttggcgttcaggtacatatgtacgaccaacttggctcgttttattccgatcagccggattataccgacccggaaatcgctaaaaaatacctgaccactgactactttcttggcgaagtagaagaagttcgccaaaagctgggtctggatcatttttatctcatcggccaaagctggggcggtgccttaacccagctatatgccctgaaatatggtcagcatcttaaaggcgcaattatctcttcaatggtcgacaacatcaacgaatacgttgatcatatcaacctcgtccgtgaagaagctttgccgccgtcagcggttaagtacatgaagaaaattgaaaaagctggtaactgggacgacccgcagtaccagaaatatgtggatgtcctcaatcgcggttatgttgatcgcaaacagccaccagcaatttcacacctgattagcaccatggccacgcctgtctacaatgctttccaaggcgacaatgagtttgttgtgaccggtaagttgaagaactgggatatcagtgatcagattcacaatatcaaagttccaaccttgctcacattcggcgaacatgaaaccatgccactgaagtcagcccaacgtatggctgaggtcatcccacatgcccgactggtcaccaccccagacggcggccaccatcacatgattgataacgccccagtttacttcaaacatttgaagcaatttatctctgatgtcgaaaatgggacttttaacgactaatatcaccgaacgcgccgcagttagcgacgcgtttttctgacgaaggagtatgaaagcatggcttatacagttgattttaaaacggtcagcaccattggtcttgaaagctcgcctgttgctgcagcattggcaggattgcgcgcaaatgaagcgcgttacatctggaataagtataaggaaccttatatcacttatccggctgccgaaaaacctgacagtctcgcgtgggttaatgaaattctcgccgaacgcgacttacaaatttctgccaagcccttggaagtcagcgatttgaacttaccggatttgcactgggttgaggtttactatcaagacggattagccatcaacgtgatgtatagcttgtccgaccccaaaaaacgcgcggttggctttaaacttagcgatggcatggcggtgccgactgagcttgaaggcaagtttaaatttgcccggcaaaagtcgaagcttgctggcaccattcggggatcttttttcgtcatcaaggtcagccattgaaaaaagacaactttttaacttgataagcttacacatacaaaaaacggccacggtgatgttcctcaatattggaggtatgacatcaccgtggccatttttgcgtataatcgtttaaacaaagactgaaatggccagctgaatatttagaacggtgatcacacccgtcagaaaatagccgacccaccgcacgagttgcgaattaacgtggatacccatcaaatcacgccgattcgtcaaggccaccaacgggaaaagcgtaaatggcaaggcaatgctcaatgacacctgcgcatagacaataacttgctcaaagttgtgttcgctaaaaccgatcatgaagccaatcaccatgatgggaatgagcgtcacaagtcgcgtcagcaacctccgctcccacaatggcatgcgaatgttcagataaccttccatcacaatttgccctgctaaggtgcttgcaatcgagctaatcaagcccgtgatgagcaacgcaaatgcgaataatgtactcattaacggactggccagcccgccaacaatcatcggatttttcaacccattatagacaccttgaaaagccgtcacatggccgcccacgccataaaacaacgctgccccaagaatcaatagcaaggcattaatcagaaaagcggcgactagatgcacattggaatcccacttaccaaaccgcagcgcctcggtcacctgtgccggaatatgctcatcgtatttgcgactctgggctagtgaagagtgcaagtaaatgttatgtggcatgatcgtggcgcccatgatgccgagactgagcagtaacatgccatgattcgtcaggatgtccatatgcggcacaaaaccgccagcaatcccgccaattgacggatcggctcgcgcaacttcaatgccgaaaatgatgccgactgtgagaatcgataccagcacaatcaactcaattcggcgaatgccaaatcgtaagaataataaaacaaccagcacatcagcgatggttaggagcattccccacatcagaggcaggccaaacagcagttttagcgcaatcgccgtccccacaacgccagtcatatccgtggccatcatagctgcctcattgatcaaccataagcagatgcggctccagtgcggaataaatgcggcaattgcttgggccagatctaatcgtgcgaccacgccaagtttaatcgccagcgtttgcatgaacatggccaccaaaatcgacatcaagagtaccgatagcaaggcgtagtgataccgactgccaccttcaagtgccgttagccagttacccggatccatataaccaacagcaaccaaggcacccggcccgctgtatgccagaaacttctgaaaaaacgaagattcataaacactcggcacctgcacgctgcggttaatgtcatcaagactgcgtttttcgcgttgcactgttaagcgttcatcaggccttgccatggttcgcctccgccgcaatcttatcctcagccaacttagctaaaaagtcacaaaacggctcgcaaccattcatcggtcggacagtcgcaaagtttttgccgccattagcacgaaatgtttgataattctggacattattttcttccagtgtttccaaacaatcagccataaaactcggagttgccactaacacattgcgcttacccaaagcagccagttccattaaccgattgcgtaaatatggtttcaaccaaggaaccgggccaaactttgactgataacacatctcaactttagtctggggcactttcttaagatactgcttcacacctgctgtggtcgtttcacattcctgttgatacggatcaccatgccgcaccatcgctgtcggaatgccatgatagctcagaataacggtatcatacgcccccgcttcataagcatcgtcgatctgttgtgcaagaatcttttgatagtctgaatgatcataaaaacggtcaataaccacggtcttcacgcctgaagccgcgaccttatccaaaatagtcttcgtcgtactttgcgtgtattcaggaaacagcggaatcaccacaatcggcgcatcaccacgcgttgccatcgtctgcagcgtttcgccaatcggatactcgccgccatagttcatcgccatctgcacatcccagtcaggcagccgctcgcgaagccgatcccgggtcacctgcgtataggcaatcaatggcgagccagcttgggtccactcatgcttatagaaagttgccgaccgccagctgcgaaagggtaaaataaaaccgcgcaaaatcggttgccacagggctttaggcattgtgatgacgttctgatcactcagaaactcccgtaaataccgccgtacatcctttgtctccggcgaaaccggcgatcccaaattaacaatcaacaacccttttgccatcctgctacctccgcatgtgattcactgaataattaaagaatagcacacgttaggactgattgcggcgttgttcaagatgctctttaagcataaccaccatgcttttctatgctaaactagtcttagcaattaacttccgaggaggcagatgaatacaatgaaaggcatcacagtctatctggtgcgccatggtcagacatggttcaaccattttaataaaatgcagggttggtgtgactcgccattaaccgataatgggattaaagatggtactaaaacgggtgtcattctacgcaacgtggccttcacacacgcttattgcagcgacaccatgcgagctactcgcacggccgatctgattctcagcaaaaacgtcactggcaagattccgctaaccgtcacccaatactttcgcgaacaattttatggctattttgagggtgaagattctagcaaaacttggtatgaagtcggcttcccgcatggtgccaagacctatccggaaattttggaaaaatatggggttgacgcctcaaaagacttcatgcacgatgctgatcctttccacgaagccgaagatgcgcgcacttactggactcggctgatgaaaggcttccgccagttgcgggccgaaaaccatgaaggcgataaagtcctgatggtcagccacggcacgaccattcgcagcatcgtcgataagttcggcaaaaatgatgggtatgtggtcaccgattcgcctcgcaacggctccatcagtaaaattcttttaactgatgaaggcattaaagtattgagttataacgagtttgaagcatagtttgtccaaaccgaactttttgccacttttgtattgtcgagcaaataaaaatgctccttcggacaaaaccagtctctaagggcatttttatgttgttcatctgtcaatagatgtctgcacacgacgttttagccggttaactttaagcgttcaaatctgctatttttcaagaaaacaaagatggtaggctcaaacttcttgccgtgccaaactccggtctttaaaatcacaataataatccatgaacaggtaaaagcgaacaacttcccgatattagggaaattgttcgcttttaattgtcagctgagaattgtgttccagcctatagtgcgacctaaaggatcttttctttaggctttttccgctaagttcttattgatcacaatgctctggtacatccaaactgtcgccagataatagagtgcatacagaacgatgaacaaaccgaatggtaacgcaagatgcccgtatggtgcgcgcaacatggtcttaaaaagctgaaggccaaacaagacgtggataatgccaacgaaacctgggagtaagaacaaggctccgatttcttgccgaattgagcgtcgcaatgcacgcggtcgtgccccgattttctgcaacatcagataacgactcttgtcataattggccccagatagaatcttgaacatcagcgtcgaagctaacatgccgaggaaagcaatgccgaggaagaagcccataaaggcgaggccagagaacatgctgttcactagcgcataaatcataaacttctgatcgccgttactgctccataatcgcggatattgcttgctttgcagctcgacaattttctgaatcgtgtcgtagttttgaccgaaatccttaactttaaacgtggtcaaagtttctgcattcccgagcttcgcgaaggtcgcggcatctgcgactttcatttgtttacctcgattattgccgataaaaataccaaaagaacttgggtaacgttcagtcatttccgcaaagttgcggctcgtgactttaatattcggcgtatcaagtcctccgtcattcgctttgatttcaagcggatgggcatcgagagcttgctggctgatgtaaaccgttttggcatccgatttaatcgtatagtcttgcttagcagtgacatcctgcaaccgactgatttgcgcacgagtcgcagcatttggcgaggcaactgttaaatcgtaggcggtcgcctgactcgccaaatccggaatatcatgcgtaaagccaaggccaacagtaatcgctcctaaagctaaagcaaacagcatggcaaccacggataaaatccgcgtatagtcccgaatccggaaactcaactgcgacaaggtaaacgtatgcaactgtttggccgcaaacttgtggtttcgcttcaataagccaatcagcgctacaaagactgagttaaacaggaaataggttcctagaacaatggtaaccaaggccaatggaatcgccataatcccgattttagcgatggcatacatgctgtagtaaccaaccgcaagcaaaatcagccccaagacaatctgtaagacgaaaattcctttgcgttgtttgattcgatttggtgtctgcgcttgatgcaacaaccgtagcattggggttttcaatagttttccagcattatagaacgccgaaagaatgaataagacaatgaagaagcctaatgtccacaatacggctggcagccaaaacgctgagaagccagttgccggcgcatgtagggtgttaatgagccattgtcccacaaaggttgtgccgaccatcccgaccaaaataccggcaactgttgctaaaagcccaattgccacggtttcaaggaaaatcagttgcgcaatctttcgcccttttgcaccgagcatcataaacatcgcatagtcgcgttgtcgcatgctaagtagaaaactattggcatagacgatataaaccaacgtgataatggccagtagcaccgcgccgaaaccaaaaataaatggtgtaaagccaatcggcgaatttttctttaaaaagcttgtgtttgtggcaagtgacatgaacatgtagaaaacggcgctggcgataaccagaccggaaaataaaaccgcatagtcgcggaagcggttcttcaggccgccgagtgcaagtttcgttaacatagacgacgccccttacttttgaaatgtgccgagtgtgtcaagaatctcctgatagaaggcttcctgactcttatcaccatggaccagctcggaaccgatttgcccatctttaatgaacaaaatacggctggcataactagccgaaaacggatcatgggtgaccaacaagatggagacatcctgttccttattcaactgttccatggtatccaataactcacgggctgacttggaatccaaagcacccgtcggctcatccccgaacaggatatctggcttctgcaccaacgcccgggcagcggcaactcgttgtttttgaccaccagataactccgttggatagtggtcgagcacttcattgattcctaatgtttgggcaatgctatcaacagccgccgcctgcttcttcgcactcacattttgcaacgccagcggtagggcaatattttcgcggccagttaggttctccaacaaattaaaatcttggaaaatgaaaccgatttttttagctcgaaaatctgataaggcatccccttttaattttgtgacgtcagcacctttgatcaaaacggagccagaagtcggtgtatctaacgtactaaggatattaagcaaggtcgttttccctgaacctgatgcgcccatgatgccgacgaattcaccgggttgtacttcgaaactgacacctttcaatgcgggtgtttgtttttccccttttttaccataggttttcgtaacgttgtcaacagttacgacaggttgcttgtccataatagacctccatttgtatctttgtgttttgtttacaactttatgatagcgggttaggctgcctttttcctgataatggcctaacggatggttgtttgtaacttacggctttgtaagctgctttagtctttctttaccttttgccgcaaaaccgccgcaatccctgatataatcactaatggcttttgaaaatatacatgaaagttgggtcgcagtgggaaaactccgtaataaggcgccggggatgagtttaaaaaccagtcgtttttaaaccttcagatatttaaggagccttttatatgaatgaattagataaaccacagaaacaatatatcccttgggtagttgtcggcctcatggactttgtcacagtcattgggttcgatgacatcatttataacttccagaatcaaggactggtcgccttcaccagttggatcatcatgactttcttctatgtgattccttacaacctgattgtcgcgcacatgggctcgactttttccgagcatggcggtggcatcaccagctggatgcgtgaaaccaacggcgacactgtcggctactatgcggcttggttctactggattaccggcctgccctacgtcgtcgatgtcgccaactctgtcgtcatctcatttggctggatcgcaaatggcaatggcaacattcaagccaatcttggcaatgcttggtttggaattctgaccgccgtcattttcgtcatcttcatctggcttcagcatttcttcaaaaataaaagtctggaaatcatgtcaacgatcggcggtggcgcgatgtttatcatgaccgttctcttcgtggtgatgacctttgtcggtttgtccaaaggtgcaccaattgccacgcgaccttttgatttcaaagcttttattcccaaagatttcttctcacttagtttcttatcaactttcggcctgttcgtttttgcgatgaacggctccgagcttgcagcgccatacaccaaagacatgcgccatccagcccgcgacttccccaaggcattgaaaatgattgccatcatgaccatgtttctcacattattcggcactttctcgctcggcgtttatttcaacgctcatcacttgccgaatgacttgaaaatgaatggttcctattatgcttttcaggcaatcggtcgccagtttggattaggtaacagcctgatgtatcttttcgctgttgtccaaggcatctacatgttggcccaactagctgttattcttgacgcttcaacccgcgtctttctatctgacgtcgccaaacgctttatgccacggcaattaacgaaaatgaatgaagacggcttgccaatcaacggctattggatgaccacgatcctttgtgctttgatcatggcgttaggtgctttgctaccaaaaatcaacgacatctttaattggttgttgaacctcaatggcattgtcagcccgttgtcaacctgcttccttttctggtcttacaccatggttcgcttacatcaggatcgcttcccgacgccagcctatacttatctaaaaaatcggaaggttggcttattcgttgggatctggatgttggggattacgttcctgcttggcacgcttggcttcttcccgacagatgcgactgcggagacgttcgctttaatgctggttttaaacattgtcgttccgattggcatggtggcccttggggttttgatgccatggatcgcccaacgtcaacgaaaagcgagaaacggtctcgcatttggcagaacaacttggctcggcttcaccgtgatcattttgctcggattggtcagtgccgccacatatggcatgcatgtcaacctgctcaaccatctcaatccaatcttgcaatggagcatcatttttgtcgttgatctcgtcatcattggtgtcgttgccaaagtcaccgccaacggccgccgtcaaattagcactgactaaccgtttttaaattgaatcgtcactagctacgaccgtcaaaatcatacaggcggtcgtctttttatccttaaaattatcaccggccagcatgcgctatcgttcaccgtgataaactagttaataggaggtgccgccatgctcagctatacgattatctacaacccggcgtccgggcattctaaaggaccaactgctgccgaacaactcaaaacgaaactggaagatcgccagcaccaggtcacgatggcgccaaccaaaagtgccgatgacgcgcgcgaattcgcctatcacgcccaagcagacattgtggtggctgtcggtggtgacggtaccatcaatcaagttgtcgctggtctcgcaccgcgcaaaaatccgccactgttggccattttgcctgaaggaaccgttaataatctcgccaaggttttgcatattccgttactgttgccgttagccatcaaaaacattcttgaagctgccccacagccactcgatgttgctcaggtcaataataactacatggtcagcacgttgaccctcggtgtcttagcaaatgcggctttatctgtgacccagaaagaaaaacaacacttcggcccgatcatctacctcatgaagggctttaaagttctggctcaacatcaacattggatcctgcagttggatagcgctgatggtaagtggcaaaaagacacgcagttcctattaatcacgatgacaaactcagtcggcggcttcaccaacgccgtccctgacgctgcccctgatgatggtcggctgcacgttttcctcgcccccaaactgaccttgtggcgatcactactagcaatcccgtacttcatcaccggcaacttccaaaaactgcccggcatgacctactttgcaaccaaagagttgaccatcaagacaccgaaaaccttacaaagcaggattgacggcgatcctagtaccaaaacgccattgacgctgaaagtgattagcgatcatattcaggtcctggcaccgaatgttgggtagatttgggctaccgtgttacacttggtctaatgaatcgaaaggggtgaatcgccatgcggttacgtcaggcgcaccatgaatgatgatctgctagcaccgatccgcggcgaccaagcccggatcaatgaaaggaatttatgactgaacaattatccaatgaacctcaatcagaaaatgttttaattaccggtatctcgcgtcagcagcccgactttgattacaccatgaccgaactcggcgaacttgccaaagcggataactacaccgtcgtcggcgaagtccgccaaagtctcgatcgcgccgcagccgccacctattttggcagtggcaaagtcgacgagattcgcgaacttgctgacgtcaaaaacgcaacgactatcatcatcaacgatgaactgtcgccatcacaactccgtaatctcgaaaagcaaaccaaactgcacgtgattgatcgaacccagctgatcctagatatcttcgctgatcgtgcccgtagcaaggcagccaaaacccaagttgaaattgcccaactgcaatacgcgttaccgcggctgcatcccagcgccaaccggcttgatcagcaggttggtggtggtgctggttttgccacacgtggttcaggggaaacacaacttgaacttgatcgacgggttctcaacaagcggatcagccatctgcgtcgcgaactcaaagacgcgagtgttggtgatcaggtccgccgcgcccggcgcgaaggtaatgacatccccgtcgttgcattagtcggttacaccaacgctggcaaaagcaccacgatgaatggcttactcaatctttttgccgaccgtccggaagacaaacaagtttttgaaaaagacatgctctttgccaccctggacaccagtgtccggcaactcaccttgccagacaatcgcaagttcctgctcagcgacacagtcggcttcgtctcaaaactgccacataatttgattgacagttttaaagccaccctcgctgaagcagccaacgccgatcttttgattcaagtcgtggactactccgacgaaaactatccggaaatgatggctatcactgaaaagacgttgaaagaagtcggcatcgaaaatattccgatgattgaagcttacaacaaagccgatttgcgtgaaggcacccgctatcctgaagtcactggccaacgcatcgtgtattccgcccgcgacaaaaactcgttggaagccctgacccgtctgatcaaagccgacatcttcggccaagacgaagaacacacctacctgatcccatttgatcaaggtcaactcgtcagttatctgaatcaggaaactgtcgtcaaggccactgactaccgcgaagatggcacgctcattaccgctgtcgtcaatccagtacaaaaaggtaagttggcccgattcgctgtaaaagaagaagtttaacccccttttgctgggaaagcacaaaagaagagcaccaacagcaatcagattgccgttggtgctcttttctttttttgtctaggttgctccggttagacgcatcactagctgtccggcaaagaaacacctgtctgcgtctttattccaaaacgccaaatttataaccattgtcacgataatattgaatgatccgcggcaacgttttaaccgtcagatccttaccaagggcatcatgcattaagacaactcgcacgttactggccggataaacattcagggaacgtagatggtattgcagcatcgcatcctcagtcttcggctcctgcgccggactaagtgcatcgccgactgccgcatcccaatcaatccaatcgagaccaagccgactaagcgcgacgtctgcggcagccaagcccttccagctaaaatgaccacccggatatcgccaaatatgactgcgaaaatccgatcccaaaacctgttggacagcggcttgggcactcttcgcctcattctcgattactgccgtggctcccacccgactaggataaagcaaactataatcgtgcgtcatgctatgtaatccaattgcatgcccagcatcatattccgccttaagaaccggcgctgtctctggactgacctgcttgccaacgacgaaaaaagtcccatgaacgccagcctgactgagaatatccaaaaccttaggcgaattaaccgtattcggaccatcatcgaaagttaaaaataccaccttctctttaattggacttgtatacggtgcatccatctcttgtttgacttgggcaactggataagcatattgattggcctcagcaatatgattttggcccacctgtgccgctttcgactgcgcctcttccctagaagcctccgctgctgcccgtcgccgagatgacacagccgcaacatgccgttttgatgccttcctcgccgcgtgccgccgcgacgaagccacagccgcctcatgctcactcaccgacttcgcgtgcgtcttgcttgctgccatggccgctgcgtgtcggtctgcgtatagtttaactgaaaagatggcgattacgattaggaaaacgcctaatgtaactgcccaccattgccacctgaatttgctcttcatcaaataacctcattcgttgtttcatacacatgcagtattaaaagtaacataaatgtacctcaaaacgatattctttttaactcggtgaattgtgctcatcagacacataccgcgcgtgccggctatccagtgccagacaaacgccacagcccgccatcgattatgccaattttttgcaaaaaaagaaaggttacccaatgaggtttacctttctatcgattgctattattcactacagggtcggtaatcactatttgtcgcggccatcacaggcaattgccgcgtcttcatcaaccggtaaaatgatagttcactttaagtccttctgattcatcaaataatttgacttcaaataatactcgatgtcatcataagttttaatggccttttcggttttctttgccggttttgtcgtcaaggcaccattaatcatataatggttcttcgtgccaaagacgggtacttgttgttcaagcttctgcagtacctgcataaactgagatccttgccaccccgcatgggtaaaaatctcaggtagcatatacataggactcattgtcgggcctgtgccgctgaaatcggtagtcaataatttttttgcagcttgattagaccaaatgacatacggcgtgttgtagtagttctcatatccttcgtgggtcgattgtttcaagttaatccccaacatcttgtacgttgagttcttgtcgcctccccaagggttatggtcaccccaaaaagctaagaccactggttcatcaagctgatccaactcatttttaagttctagcaaagcatccgaggtttccttaatgcccgtcaaatagttgttaataatcgcatagtccttcttgttataaccctttttccaaggaagtagcgcctcaccatcaaacactgtgtcgtaaggtccatgattttggatcgtgactgtttgattgaaaaattgtttaccattggcattcacctgttttaattgttttacaaggtctttaaaaaccaaggtatcaggcacgacgtcagcatcactaacatgttgatcatagtagttgtctctaaacagagttttctggaaacccaagtaccgatcaatattttgccgattataaaaccatgcatcacctggatgcatgaatcgcgtgacatagttttgctcattgaaataatggacaaaagagttagtcatgccattaattggactcatatcggaaaagccagttaaaaccttacgctcggtatcaattgtaccgccaccaaaaatcgtagttgttaattgtcctgccatcccttcagaagcaacctcatgcaaacctgcatagacagaaggatcaatatctaaatcagaccactttgaaaagtcctgaaaagcctcaagctgaacggtgatgatattaatacgtttgtcagcgggaatactttgatattgatatttatttaaagcttccttagcattgtcagcactgtagttgtctggtggcactaaccaatcattcttgactgaatgaataaacgcaaacatgtaaccattcacaacgtaacgatcagcatcaggtccccaagggtcatcattagccaaaacatagtgatcgtcaacgagatagtaacgactaaggccatatgctgacccaagcaataaaagaaagaccatgactaaccgaacgttcaatcgtgctgataccggtttcaaaaaaagggtgataatgaccgttaataacaacaaactgccaattacaaataaatatttggctggcgggacataactataccgtgcacccatattacttgcctcagatgccaaggaaatgtcagcaaagtcaaatgggtaatcacggtactgcaacataaaataattcaccattgcgacaatgattgccggaatctggccaacaaaaacggccaacatcattcggttaaaaagtgcataggcgatcagcatgatgacaaaaatcggcgtgaaattgagtaaaagtaacgttggactcgtgaaaaccatcttggtcagtttcaaatcatacgctgctgatgacatgtaaatcgttgcaacgccagtaataatggccagcacagccagcacaacaatatttcttgtgactaacccacactggtgccaacgatactgtctaaaactggtaaagaatttacgattagcatagatttttgtaacaggttgtaactgtgtacctcgaacaatttgtcggtaaaaatgcggggatacaacaagggaataagtccgcaaataagttatcttttcagcaagtgggcgcgctgctggtaaaggataaccttgctcatctaaatctaagccaatatgcctaccccctgatagtagccagtccaaaagcttgtcgggtatcggggccacaatccatgtgtcagacttgaccttgtgatgagatttttttacgagtcgctggccaagtcgtcgccatctcgattcattgattggttgtttgaataaccattgccagtatctagcttgaaaggtcgttatatcaatacgtttgaacctaaacaacagccaagcatagcccattggaaagatgatccaaatttgccaaggtctataccgcaaataaaacagtagaagcgtagcattaaaattttgccggttaaatcgagtatcaatatcaatcacttacattgcctcccaaacggtaccatgaccatcccccaatggacatttttcgtacagccaaaaattattaatttaatgctcaaaatattgaataattttaagcatatcatgatcccttgacaaacaaaaccgttaactgcttaactgtcattttagttaaaaaaattaaaacaaacgggctgcttacctggcttcactgtaaaaacggccggtctcccagatcgagaggccggccgttattttcgtgagcgttaagcttcacaggtagtgtgctctgtcgtcaaactttaaaaagccatttggtatggaataaaggttttgtatgctccactaatcaagaaaatcaagacaaagatcactgcacaaaccccgaccatcgacaacgtccgcgtcttttttggcataatcgagaagacgattgttggcaagacaatagtctctgttgttgtcgcgatagttgacagacggccaccaatcgtcgacagttgcgacaatgacaataatgtcaacgtggcaaataagtatacaaccatcaaaaacttgaacttttccgatccaccaatcaaggcattcgaaaccataccacggtttaaaatgtaaaagcctgtgatgcaaatcataacctgcatcaacgttaccggatcaaacaaacctgaagataaataattagcattagtcacatatggtgcatatcgaggcaaggtatggacaatgatcacgcttagaatcttcggtgccacaaacccgacagctgcaccaaaaactaaaaagcctagtacccatttaaaattaattcttctaaaaagcagccaaaatggatagatcagcaaaaagaacaacgcggaaacgtggattgtggccgatagaccaacgatcaccaagaatggtaacggcttctcatcatagacaaattttaacgctaacatgcatgtcacacatacaagcgatgcgcgaatttgccccatatcgcgcataaagaaaaaacgactcaagtaatacgcgatcggaatgatagctggacgaaaatattccttggcaaagaaataaaaaagtgtcagcgtgacaaccgcccatgccaagagaaaaagccaaaacggtgcgtgaatccaattaaacaaatttcgtaaaaatagaaaccctggctcaacctgtcctgccgaatagtcaccagcgtatattgtcttgtaagggagaaaatcattacccgtttcataccgcaacccggctacgagcgcgagtatgatgacacctaaccaagcccagatcgatgacatggtcacacgcccgagtaacatgaagatcatcataattgcaaagagccctagataaaaaaccacgacatcattctcctattacccgtcatgagacgactcctaaaaatcgtcatcaaagtaaatctcatctaatttgatgcttacgcttgatttaaaaccgtaccgacaagttccgcattcaagtcgcgaacttgcgcaattgtttgtttaaccaaccgtttcgaaggaccatctgctttggcaacgacaatcacacccgatgccagttccgcaatcaatcctgcttcgctcgcatcagccatggccggtccatcaatcacaatgatgtcaaatttggtcttaacttgttgcagaaattccttgaatgctgcacttgctaagagctgtgccggatccgccaaagattcgccagcaacggcaacggccagtcggttgattttggtatcaacgactagcttgtcgacatcaacactctcgagagccacgtcaactaacgatgctagcccatcttgggcctttagatcaaataccgacgccaagatcgggcgatggagattaccttcaaccagaagcgtccgtttaccttcagttgcgaagctcgctgctaaattagctgcaacataagacttgccctcccccgacgttgccgacgtcattaacaagacaggaacgtcatcacggctcacttgcaaggcaatattatttcttaaagtgcggaactcttgtcccgaaaccgattcatcactaataaattgatgcgtatttgcgtttgtcatggaaaactcctcttaatttgttcaacaaaaccaaatcaaaccacattagcgggcagattagagtttcttaagtgtaataaccccaagaacaggtgcattagcgatttgccccaatgtttcttttgtcttaattgtagcctttttgatttctctaaggacaatccaagcaagaccaattaagaatcctacaacagcaccaagaacaatgatgaacatcggtttagtacttgttgctgccgaactgggtgttgcctgtgccagaattgtcactgtgtcattgtgattggtaatagcagagatagtcttttgaaaagcagcggccatttcgttagcaatcagtgccgcatccttgctgtgtttagcggtcgcatgaatcgaaaaagcacgggaattatcttcattgtcaactttaacttgcttttgcaaatcaccactgctgatgttcaggttgtcctttttcaatagttgggctgaggcttcatcaaagacagcagatgttttaaacaaggacttgctggttgccaacaattcagaatcatactgattttgattcaacatctgattgactgattcagtattatttttctgctgattaacaacagtgagtgccgtcgaagaataagctggtttcatgactccatatgcaaaaccggctgccacagcagcacccaacaataatgtgcagagagcgagccaccagctcctacgaagtgataccatcaattctttcatgctcagtaagttttccatgattcctccatcattaacacgatttcttaaattcacaaacagtgtccgactcagcagaccctatcgtcaaaacaacattgcaatgtgtctaatgtaccacaatatttccagagatcagccagctcaagaattaaagacatctgccttacaaacctttctcaagttatcttctcggttgatcggtcgcttagaattttcttagcgaccatccgcgtttttatgataccgcaaagaatgcggaagtcatacgtttgagccggatttaaagaaatttgcaaaagttttcccccaagcaatggtgccatttttgatggaagagaacaatgaactgtgaatcatcttgtaataataagatggccaacgccaattgttatacacaccttgaaccaaaatcggaaagaacaagagaaaatacatattgccgtctgtcagttcaagcccgagccaaagtcccaacagattggtgcctgcagaaatcaggaacgctttggtatatggaatgatgtttgcgttcgcaatataggatgcgtgcacagaatgctgctgatagaggaaatagtacaaaagcagcggcaagaagacctgaagtgtcggcacagatgcaggcttgatcaacttcaacagtgggaaaatgaccagcaatgtccccacaaccgcaatgacgaacaaccaaacataggcggcaaccgctttagaggtcttgtccctaatggaatcaaagtcttgtttgacaaagtttgactgcaagatcggattataagccccattgatagccgatgccgcggtgccaatagcagaagcgaactgaacacccactgaatagacgccggtcactgataatggcaagaaagcaccggccatcagggacatgccttgtgacgtcacataattagacatgctaaccagcccatcacgccaagtattaggccagataaacaaaaacacatcttttatttctttccaattcattggcgatttcaaggcgtcccggtgcgcacgaacttcttcgtcttgccaataaaagtgattacaaattgtccggaaaatgatgccgtacatcaccaaaccaataacaggagctagaattgaaggatagagcagaaaaccgccaaaagttagcagaatttgtaatgaacgtgaaaacacttgtgctttattgacagaatcaatcttgcctgacccacggagcaacgctgaaaaatagccaaaatagaggttcaaaaacaacgagaaacagaatacaagccaagtccacttatattcagccgcgggcaatttgctaaaaacaaaggcgttcatataaatggtcccgaaaataccgaccaaaataactgccaccagcgccaaaatcatgtaaatggcgcgcgccgcgtgaatcgttgatgccaatagatggtagtttacagcggtgtgatcgtgttcttgatcaactccgcgcgacttcaacgtttttgctcctgaccagatgtaagcaatgtttcgagcaaaagctggatcaaagccaaaatcaaatagcgcaatcaagccgttgatacttaaaatcaaataccaatatccgatttcttgagaactcaagaaatgaaaaataattggtagcaagataaaattgctcgccatcgaaaaaatagtccctgcataactccagacaatgctttttttggttacttcaaaccgatttcgcaactcatttcctcgtttcacttgacttcaaagctttgataaatatcgcgcaaccgctgttgcattaacgaccatgaaaattccttttgataaatttgccgcatcaaggttgcctctttagcccagttttgacgcttatcaataagacgttgcagtccatcagctatatctgcttcagaagtgccacagacagcaccgaaaccatatttaatcagccaatcagacatgccagacttttcgatcatgagcaatggcttgccaagttccatagcttcaaaaaacttgttaggtgaagcatataagtgattttttagcacaggatcatataacgccaccagaatatcagctgttttttcaataccatttacctgatcataaggcacaacgccaagatattggatgcgcggatcacgtttaccagcatcagcaaacatatcctgatactggccttgaccagcaaccgtgagtgacaacgccgattttttttcaacggctcctaacagctctggcaaacaacgatatggacttaacccaccaatataaacaatcttaaaatctttctgcgtcgggtcaaaggcttctgcattagtagcaactggactatccaatggcgaattataaatgactgccaaatgttgcggcttagctggttctatttgacgacgacgatcttcagaacagataagcgtccaatcagcagtggccatggtgacattctcccaatgaacaaccatttttcgataccattccgggtaatttcgggtatcaggtgcgtaatcaaagatatcataaaccagtttggttttggtcttcttggcaacctttgacgtgatataacccgtatgcacattacatgcttgaaccgcatcgtattcatgcaagtgcttcctcaaccaacgatagagaaaagcttcaaaacgcataaaagcaaaaactttaaaatatttaaaagaatatgaaatcttaatgccggcaaagatcgccttcaatgtctggccgtcaaagtcaaacgtatctgtcgtcattcgtccatgcggatcttcacgccagccaagaattgtgacatcatgaccagcagcctgcaaagttgcactctcttttaacaatcttgaatcatcatcgacatgaccagtcgatacaaatagaatcttcatggttcctcccagtttattgagaatgatcgttaagacacgccaatctcagtccaactaatagacatacttcagcaagaacggcagtacttctaaaattcgaagtttgtagagcatgattttgaccatcaacttcttatcttttcgatacgccacgagttgcttaaacgaatattgccgcatcctttgacgaatctgctttttaatctcagggtctttcggaccagcaagattttggaagaagatcgacaagcgtctccttagcacatactcattgatatcacgattcgaagcaagcccactctgccttaattgacgttcaatctgatcaacaactttggcgtaatcagtcagcttcttagtatcaacttgatgaacggtcgagtcattattctgatagtaataatacaggacttcgtgcaatctataaatatgctttgatcgtaatagaatcggcacaaaaaaagccaagtcttcagcaaagctacaatcaggaaaaatgtccgacccaatcaagtcgcgtgcaaaaaccttattatgaggaaaaccgccaacaacatcccgcgaactgcctaacatttcatgaagaatctctggcaatcctactttttgactgttaacgttaatttgagcattggtctgaggcagcggtgcgccttgctcaagaggctggtagttaaaaataaaaagatcgaagtcaattgtcgtcacaatctggagaatccttaaaagtgcatcactccgaaccgcatcatcggcatcaataaaccaaatatattttccttttgccagcgcaaggccagcatttcgggcacttgcaacgccattttgcttctcaaagaccactttcgtatgtggatgagctgcccgataagcctggataattttaacactaccgtcagtcgacccattatcaactagaatcaactctacgctcggcggaatcacgccgatacttttcaacagtctctctaaataagcttcaccgttatatataggtataataatactcagctgatacatactgcctcctgatgaagatactatcgattgaagaatttgttttgaaatgaacacaatgattgcccttcgcaaaacatgaaggtcgtcagaatttttaaagaccagacttcaaacgtcaacaaccaatctgattttaaatcgtcttaaaaaagaacattgccgtctgttcacattgaaagcattataccatagcaccaaccaagaacttagtcggtctaaatatgtgatgatggcagtaacttctgactttaacaaacaaccatattcgtctgtatgttaaactattttgacgatatttttttaagagaaatgcgtggattcgtgactgtttttcagtgagaaaatcgtaagatagcttaaaataatcaacatggggaataaggactagttaaattgggggcatatacttaatgagcattaacagaaccaaattactcaaaacaagcatcatcatcgtaatactaggtctgatcagttttttaaatatcctaccactactaaatttcaactttgcaacatcgtatatgggtgatgatttctttttccatgttcaaagggttttggcactgagcaatatctttaaaagcccagtgaattttgatgttttcgcacatactgccacaatggcaaacatattctatccttgggaaacagtctatccgctttacctgatctatcacacaaccggcgactttatttttagttataagctcttctactttctaataacattcttgacagcaatcttggcttattggtgtttgttcaaaatttcgaataataccttcagttcattttgcttcgcggcactttacgttttctcgttttaccgaagtaccaatttctttgtacgctctgcattaggtgaagcagtcagcatgacctttctgccgctggttctgctaggactatactatattctctttgatgactacaataaatggcgatctctcagtgtaggtatgactttgattacctattcgcatacactctcacttttcatgaccagcatcttgattgttgttggcttcatggttagcttggggtttttagatcaacgaaaagcccgtattaaatcgctttttacagcgggtttttggaccgtgattttatgctccccttacttatttttggtaattaataccagcttaaacaataagctctacttaaactggcaacccgccttgcatgggctgccgttgaccgactggctgatgaattcgctaggtaatcgtatgtacccaaatctcaacgtcagaagtagtttaggggcttctgtcgtgatcgctggtgtcttagcccttatgttgttcatcatcgtgaaacgatcccgaacagcttttagcacattctgtctatggggtggtttgggaatcatgcttatctcaacgtcccttttcccttggtttctaacgaacaacaccatcttcggcagaattcaatttgtgtggcggttaaatgcctacatatcgcttctcttgcttgcaagttttagtctcattcttgggaccgtgattcggaaaaatgttttgttgaaatccgttttcttattagcacttatcgcaggattgataattggtaatacaacggcgcttgccacttttacggctgccaaagctgaaaagacccctcgagaaggaacacttgtcaaaaatgttaaaaatattttttatggtgactatacgccagagcaagtccagagcaagaaaaatcttcaacaaattttacaaaagcagttcttcctaaacgcgcagcaaattaatccggtctatcacttcactgacaatgactttactgtacaagttgataactcaacgcaatcacacgcaagactgacaatcccggtattctggtatgcgagtcaggtcgtaacggttaaccaaaagccggttcattcaaaaatctcgaaaacaggtgcaacccttgttacgatccccaaaggcagctcagtgatctctgtctcatatcaatatcccaagtcagttgttgtttttattgtgatagcttgctttggactagcagccatttttatgccattgatctttcgcaacacaggctcggcaaaagttacaaaaactgactaaccttctcatgacgtccaaagcgtgagctggtttctgcgctagcgagcgcattttatcctaaaaatgacattactaagcttaaaaacagcctcgacaagatgcatgctgagcaacgcatcttaccggggctgttttgtttaatcagcgcaaagccttattgctttacgcaagatcgcaaaaactgaattaatttcagaagtccgtacccaaaaatgacaagtaaactgataccattaatgatcgcagccgcccagaaaagcttcgacggcgcataaccaacgaccaaatgattctcacccaatcttggtgtcacaatcaatgcgccaatattgcttcgcttgtactgtgagggctccaattttttgccatttaaaaaaacggttgaatgcttataaacaatcactggcataagcgtcgattttcgctttttagcttgccaagtgaagtcaagccgactatctacatcaacttgtttcctgacatttacgtgattgtgcagaatttgctgtttgtacgcatcataagcgtagagcgtgttttttacattcgggacaggtaaataatctggcgtgtttttggtaataacaccaaaaatgtttgcctgatcatatgcatgattaaacaagtcgcgaatctctgcctgattttgaatggttgaatcagcactaactgcaacctgatcgccttgccacgctgttgctttctcgtttacccaggtgtaaccattgactaaatttaacccagcgacactaatgaaaagcgccgagaacaagcgggtgcgttccgtcttggcattaatattcagtttttgaatcgatattgttgtacccagaatcatcattgtcaaggcgactgggttgaagcgttgcggaaactgaatcgtttgaagaacattaaaatgatcagcaagaaagttccatggaaaaagtggtgaagatagccacaaaaacaaaaatccatcaaggttaattagtttttcaacgattttcagtcgtttccagttcaacgcagcaaacactagctgaaagagaatcatcgctgacaaaatcaaacccaagtccagacgagtcatgttgccaagcgacaatcgcgaagcactgccaagtaaatcggtgactttatatggcataacaaggtgctcgttatgtagctcataaattgctgccaatgtgctagcattcaaggcaacagcgaccccaacggctgcaacggcatcaagtattgttcgccatctattcttagccaaatagagtcccggaatgaagaaaatggcggcactaataacgtacagtataactgtaaagttctgaaccgccattaacgtagctgctgataaaccaaataaaacaggactaatcggcttttcgtgattgatcaccatgcggatcagcggaatcgttgtcagcggaagtagagccgctccccatccccgcaaagccgaatcggtgacataaaacagcactaaaggtgttcccatgtataaaaccgcagcagcaaaagccatttgacgcttcacttggcagtaccgagtcaaaaaatacataccacttcccgctgttactaaacataaaaagctggaaatgatttcggctctaaaccaagttttggcaatgattaagataaaaccgtggcaataagcaaacgcactgccataaaccgcgttaataatgcgtcctgattgtcgaaacgaatagagtgactgaaaaaagttgaacttgccggtcttgagttgcatggccgcttcataaaaacgattccaatgaaattcccagtcgtcgccaactgccaaagcatgatagcttaattgcggtgacagtacaatcaacgccatgataacaattcctaaaagccacgcaagctcatgcgcccaactcagtttatttttttcgtgcatgtgaatcactccaacttccaacgattattttcaacaaagtatcatttccaaaaaaaagtttttcaagactaaatcgctcttttttaaacacgaattcattaaaaaggatcctgcaagcactagcaatcatctagtaaatgcaagacccgttttactttctatttgcgactgacaagctgctggcttggtttaaagctacctaatagtaagggcacttttgtcaatccaataaatatggccatctgggaattgaaccttaacgtaagtggctctatcagtcttttgttcaattgtggcatgaacgttctgaccatcatattgcttagcactgtcgttgccaacaagtgtcgtaatgcttgtatgataaggaccatcagcgtaaaggccgtctacccgtgtcttctgattcaccacggcattataattaacatctgacgttgaaagaattggactcaatggtgacatactcgtcaaagccaacttgtctgtccaataagttgtgccattgccaagtcgaatctggacataagttgatttggtggatcgcgaggtggtggcctcggcaataacttgtaccaaccgtccatttagagacttggtattggtattaccgatcgctgtcgcagaagatgtgtgataaggcccctcttgatacagcccatccgctcgatgattttgatcaacaatggccaaatagctgactgtcttcgtgagcaaaattttgtcgaagcctgcctcatcagccattttcaaaccacgtttatcaatccagaatgtttgaccattcgctaaacgtatctgattgtaagtcgttccacccgctcgcgtcgtaacggcttcagcaatgacttgaacgcgttgaccattatatctaggtgcatcgctgttgccaccagaagtaagggcagacgtatgatatggacctgatgtataaatgccgtctgagcgtcccttttgttgaatagtcgccgcataattcactgatttgttagaaacaattttatcaaaagaaagttgagccgttccatttttatcaatccagaaaactttgccattttgagcacgaactttcaaataagtaccacgggaagtaattgtttccgctaacacatgaactgtctgattattatacgcaacgccatcaaagttagaaattgccgtcgtcgcactcgtgtgataaggagcatcagcatagataccgtcttttcggctatcctgattgacgatggtcgtatcgtaattcactgcttttgtagaaaggatcgtatcgtatgaaggcgtttcaggcttaggtgccacggtatttgcctgcgtaaaaagccctgtatagtcaattgaaacatcaactggacttgaagcgcctggtaagtatgctaaagaggaatactgccatgcgccaaagtcctgattccataatgaactagcgctgggtgtgtatgggtaatccgcaacccaagtccggttcttaccaacagtagcaattgcagcattcgaataactataatatttgccggtatataaaacgtggttattgtatccgcgtttgttcaaagtttgccaaaatgcagttaaatttgcgccaacatctccgctcacatcattatcttcaacatctgccacaacattcgtttgtttaccaacatttaacgaatcaagtgtattggcaaaataattagcttcattgatcgcagctgcctgtgaactaaaatgcacatagtgataaaccgaaatcgccatgcccgcattcttagcatactgaatctgcttaccggcatacggattctgatagaaattaccttctgacgtcttcactaccgcgcctcttaccccaagcgagcgaagtgtgttgaaattagcctgtgtgagccaatactgataagaggcgacatcaacgacatcggtccttggtactgacttatcaccaatggtaaagctcatcatcgttaacgaactagccgcaaaggtttgtatatttgcctgtgcgcctcctgacgtcgcaagcgtgccattactcgaaaatgaccgcgcacgacttgctggggcagctggtgcctgttcagttgtcgttgcgccagcagcatttgaatgctggttcatttcgtgaaagggtgcagtttggtcctgactcgattgcgcacttgttcctgtatttgcactgtcgttctcagcagcagataccggcgtgcctaaaacaacttgtgaaaataaaagtgaagaggcaatcgcagcagttgtccaaaataacttattcttcaactttttctcctttttccccattgttaagctccttcttaattgtgttctttaaaacacgctcattacacatggacttctgtgccttttaaagaaacattctggtgacacgttttgcgtttttgtgtcaaaggtcacttaaacaccgccatatcaatcagctcatgacaacgggtctgtcaaattatcggtaaacatttttctttgaatgatcttcaaccaacgataaataaccggcgttgctaaaaggaacaaagcataatattgctcaaagcgataccgcgtctgcgtttccataactatgtaagcaaagaagaacatgccataaatcaacgctggcaacaggtaagctacccgatcgatgagaatcttctcagtcacgacatgcttaaatgttcccagaactgtaccagcataaataatgataccagaaaagtttagtgatgaaatcaacaatgaatgacgttcaagaaaggcctgatcgcctccgagattgtattgattgtcaacattacccaaaaaactagtaaatcgatccatgacatcttgaaggttaatgccatgtacaaaaacacgccgtaatttatcagcagctgcctgtttatataaaccatagtcaaagtgataggcttttaaatcataatataactgtgatttacgggcacttgttgtatattttccactaacgccttttccggtaagtccaatcaaaaacttataataaggatttccgcctttgataccgtacggcgcaacacctgaaatgataaacagtccatttatgatccatcctagaccccaaaatgcggctacaaaagcgatagtaccaagtaatctttgacggcttctgtggtagacagcctgaatcaatagtgtggcagcaatcgccatcgcgacgacaacagcggtcggccgcaaaatttgtgccaaagtgatacaagccgctgccagtaaaagattctgccaagactgtcgttttaaaataaaataaatggccgctgcttctaacaaaagtccctcatgttggttattgataatgcctgcacctataaatatatatgggaagatggcgaataatcctgcgccaaaagtggctatatgtacatcaacatacaatctcagagttttaaacagaatcaaaacggtcaaggtgatgacgatcatttcgacgattttgaaatacaataaccgataaccaaatactcgcattaacaacgataaataataagcatagccaatttgaaaattataatatctaaaatagtcactaggctgagcagcatgcttgccaaacgtaccattcacgatatcttgcgcgccttctagcaagaccttatagtcactgaccggaactggacgataaatatagttccaaattcccaataatatcagagaaatcgcggctaaaatgacgagtgcctggcgatctgataattgaatcaaactcaatttaaaaagtaggaaaaccccacaaataatgcccatgccgcccagaacaaaggcagacgtatcccatgcagcaccttgaataatctggagcttaaataaacacaacaggcaaaatgaaaaagcaattactagcagatatctgccaaatttatcaattatctggctgagttcttgcataaccctattcattcgattttccattcttcacttcttcctttcagagtggtgcaaaaatcgttaatacttcattagtgcccactcgcgtcagcgggacacctcaaccgtctatcaaacaagcagccgaacggcgatagctcattcgtttcacccccagtaacttcaaacctcatactagcatgacacaataaaaaccctctgatctttttttgcatgttatactattttgcgagcattaatgtgaagaaagcaacataaatggaggagtacctgtatggacattattttgttaccattcatcggactgatccttgcgagcatacagcagagtcagaatctcaaaaagggccacttaggaaaaaataccacaaacaacttaaagggcatcagcattattttcattattcttcaccatattaatcaggaacttggaccagttgcgggtactttcttcgcttctcggctatcattggcgggacgtcttggggttgcaatctttttcttcgtctctggttatggcatcatgcgacaatatcagatcaaaggcccttcttatttgaagaacttccttccacaccggcttctgccgattgtaacgctatacatattagccatggctttaattttccctatcaaacattttctaatgggcctgacattgaaacaagctgctatttcgatgacaaatggcgcgccatttgtcaatgatagctggtttatattagccatcattttcttttacttagcattttggctggcaatgaaattgtcaaaacgacatgcgctacctctgtttgctattttgctgttgttgacagccatttacacgggttacatttggaaaaaaggcatgggtgaatggttaatcaatgctgcttttgtctttcccacaggtgtcttatttgcctactacgaagatcgttttattccctttattcaacgttactattcaccgatcatgctcagcacatcaactttattcgccatatgttttacacttgacgaagttcacagtttaatgcgatacagaatgctcagtgagattttcttcgcactcgccctcatgatcatcagctataaagttgaatgtgacaacaaactgtttttgatcagcagcgcatggtccctgaacctatacctataccaccccttcattgccagtctcctacacggtaatgctgcaattgctgcacacagtgtcatctatggcctactcgtgatcatactaagttaccttgttgcaggcgtcattgccttcatccaaagaaaagtaaaaactattcgaccaaaagaaacaattcccgtaaaatcctaacgtcaaattgatgaagggatttaatagttgtcgctttacgttgactctctggaaagcttgacttactagagagtcattttaatactaacagccaaaatccaatgagttttaagccctgactcagttattattgagaatgttttttcttttcttgctctttctcttgagtctcctcccatgtctggtcactgataatgaaacgtggtcgatgtttcgtctccatatacgttttgccaacatattctccaatgacgccaagactaagtaattggataccgcctaaaaatgacacaatgcaaacaatggatgcccagccagcaaccgtggcccccttgaatgccatcacagcagcccagatagtaccaataaagcccaatatactcactacagctcctagttcggcaataaagacaattggcttgatagataaacttgtcacgccattaatcgctaatgacaccatatttgacagggggtaatgactcttgcctgccagtcgttcatgtcgttcataataaactgaagtgcttttaaagcccaccagcggaaacattcctcgaagaaatagattaacttctttaaaatcagcaagatgttgcaatactttactgctggcgagtcgataatccgcatgattataaacaacatccacgcccatcaatcgcaagaatttgtaaaagccttgcgcggtcacgcgtttaaaccaagaatcagtctgccgatcggatcgcacgccataaacaatctcgcaaccatctgtatatgccgcgatcatggcatccatagcgttaatatcatcttgaccatccgaatcaatggaaatcgtgatatcacaatgatccttagctgtcatcaagccagctaagacagcattttgatggccgcgattgcgactttgttggatgcctagatagtgagcatctttttgtgcaaattgttgaatcaattcccatgtgcgatcttttgatccatcatctacgaaaagaacccgactattctccttaatttttttgtcacgaataaagtcattgagtttggctaaaaactttggtgccgtgatgggcaggactttttcttcgttgtaacaaggaattacaatccacaatgtgggcagtgccatactcaaacttcctccttaactactatcgccactacaagcttctgtagtggcgaggatgactgatgatttttctacttaaatggcgccggacgattttgaatcttaccaaagtcatacaagatagcatccaaaattcgacgagatgcatgaccgtcgccatatggattcttagcttctgccattcgccgatattcggttggatcatccagtaattgcaacatagctgttttaaccgttttcggatcagtcccaactagtttaagcgtgcccgcttcaaccccttcaggccgctcagtggtgtctctaagaaccagcactggctttcctaaagatggtgcctcttcctgaacaccaccagaatctgtcatgatgaagtaactccttgccgccagattatgaaaatcaacgacatccaaaggatcaatcagatgaattcgcttgtggtgaccaagaatggcgtctgccgcctcttgaacaacggggttgagatggactggataaataatttcaatatccggatggctttcaacaacttcacgcatcactttgaaaactcgacgcatcgggtccccttgattctcgcgacgatgcatggtcactagaatcatcttcttattgggatcgatcatatctaacacttcgtggtgatagtcatcgcgaactgtttgatcaagggcatcaattgctgtattgcctgttacaaagatttggctttctggatgattctccttcaaaagatttgcctgactttgatttgttggtgcaaaataaagatcactcaaaacatcggtcagttgacgattcatttcttcaggatacggactgtatttgttccaagtccgtaaccccgcttcaacgtgcccgagctttgtctgctggtaaaaagccgaaatacttgccgcaaaagtggttgtcgtgtctccatgcactaatacaatgtccggctcttcttttgcaatgatctgacccagtttcaaaatcacattgcttgtgatgtcggctaacgtttgtcgtgatttcatgatattcaaatcatagctgggttcaatatgaaaaatcgataatacttgatccagcatttcccgatgctgaccggttacgacggtcacttcttcaaactcgtcactgcggttcttcagacttaaaacgaccggagccattttaatcgcttcagggcgggttccaaagaccgtcatcactttaatttttgccaatttggcacctcattcttttcaattattatagaatcattgttgagcaaaaggctcaaacccttttgaacttacgaaaaaagtatagcagattatcgagtgggaatctaaattactcgttaaaccactggcgatcactttatcatttcattccgttcctgcccactacgtcaagcaaaaaaataatcctctcagagttaatctccaagagaatcactttaatcagattaatgagaagcagttattgagataaaccaacctaatttaacgtgtcgccgtgccttcttgaatcgttttcatcgggtcaagtccagagatctgatagactgcattgccttcagtccaagtgatctgattctgacgggtattcgcggcgatcacagctaagtcaactgttccgtgtgtttctggtgccggcaacgcattatttgcaaaccaggtaaccgcttctttggcaagaggcaaaggatcttcaccgttaaccgctgaggccttaactgtcacagtccatcgtccttcattccaagttaaataagaagaacccgctgctccctgacttgccgcgtaaatgccatcaccgatcgcgacttgtggcaacccttgagttgattgagcagcgccaatctgtgcctgagcttgcgcattattaccataagtcttcttttgaatcgctaattctgcattcacattttgcagggttgcatcattataagctaatgcatgacttccaggactgaagaaaatcgagtaattttgactgtcgccagtggtaaaaatatttaagtattgggtttgatcaacttgataagcgcttggccacttaggattgccaagttgcctaaaagtcgcctgtttcaaagcggcatagcgctggtcaacgtttgcagtgccacttgtattggtggtagaggaagaagccgcatctgcactctcagttgtgcttgagctagtcgaactgctgctcttggaggctgtctttttttgcttctgacttgttgaggctttcgcggtctttttgctagattgagttgttctcaccgatccacttttactgctgctttgactgttctggccacacccagctgtaaaaagaagcaatacggcaggtattaataatagtgtcttcttcatctttattgcctccctacttatctagttatattatatgccactactcttaataattcactgacaggtcaattaactttccgaaaataaaaaacatggttccttggaaaaggcagccatgtcaatgaacttttattcacttcaattaacttaaatgcgtaatgtcctgttccaccacaatatcatgaagtttctgacgtggtggttctgggtcttcatctaacccttgtgaggaaactttgtcaaacaatattttaattgtttgcaataagatacgcgcatccagaaaaatactgtaggtcttaatatacagcagatcgaacttcagtttactatgataatcagaggcatacttgccataaacctgagcataaccagtaataccagcacgaacgttatgccgcaagtaataatggggttcctgctcgttaaactggttcacaaaataaggtcgctccggtcgaggacccacaattgacatgtcaccctttaaaacattaaagatttggggtaattcgtccagccgaaatttacgcaaatacttgccaaccggcgtaattcgtgagtcatgtgcagttgccaaaacagggcccgattttgcctcagctgtagccgacatcgttcggaacttcagaattttgaactcacgttggtttagcgtaattcgagtttgcttataaataattggccctggtgaggtcaatttaaccaataaagccgtaaccaacataaatggcgaggccaaaatcagcatgagaagtccaacaacaatatcaaaaatgcgtttgagaacggcactttcaaatttaattcgaaattgtgtaattcccatgacgctttcatcttcaaagttcataaggttgggacgcaacatcaacaggttatcaaacgttgaaggcaggaggatcgtcttttcgcgcttaatgatgatatcaataatctcacgacgcgtttcatcaggcaagctcttggtcagatagaaaatgtctaccttatcgataatggctttggcattctcaacaaaatgatcagaaataacgtaggtgactttatgcttattattcttggccgaattgaagttttccaaaactgctggcagttcatgttcataggataaaactgcgactttgtagttactcgtaaagcgaatgtacatgtaataaatgaacacccgccagacaccaagaatcaaaatgctgagcaggaatgagtaccccagcaccaatcgtggaaacgcgaaaaatcggcccatgaaggtgatcatcgtcaatcccaagatcgtaatcaattgtgccaaaacagtgttgaagatgatgtcactgatccgccgattataataaacgtaaacgcctaggaaaaaattaaccaataagaacagcaatgaaatatagatcgctgatccttcatacattttaaagttccactccggaatgtctacaccaaaacgccaatagaaggcgagtaggatacttaaattaaaaagaccgacatcaccgatcatcgttaacagccgtttaaagccattccactcggcactctgtttcatacagcaaccctctcaataattatctttacttgaaaacaagctcacttattatagcatacgtctaaaatttgaccgcactgaaggccggtgtcaacctgcaacgtgctggatgatcaatagccatcaaaaatcagcgttggtcaggaataccatctctttccgcactcttaatgcctcttcgagcggaaatgtctgcccacaaatatggaaagaatgtcttaaagatatgcttgaatcgcccacgaaaccctagattcgcactgccccaagaattatcgaaaagatgttccatgtaattcgcactccgatttcggcttgcatatgtaaagtaatctcgaggatagacaagaatccctgacgctagttcctgttgttttccattcatccgaaactccggatagagcttcatcaaaattttagtcaccactggattactcgtcatattttgcatgtcattttgcagttcaggaaatcgccgcccagcatagacatctaaaatttttgccaacaatggttccttggcctcggcaccaatgaatgatgtcaaaatgctgttatcatattgaaatccccataccattctctgctttaaaaatggcgcaagatcttttttaacgatcatatccgtatccagataaaacccaccatactgatacaaaaccgcatagcgcaactcatctgccgcatagccaagtttaccagcttgaaacattttttccgaaaacgcgtattgactcaagtcaaagttttgatcgttccagaatttaaattcccagtccggcaatttctctcgccattcttggacacgcgcctcaacgaaagcaggcggttttgtcccaaaccaggcataatgaataatcttgggaatcatcatcttcctcttttctgcatatcagcgtttgtcagtaatgcccatcagcgaatagtgaatgaaataatacaaactctcgaaaaatcctaaatgctcatgctgccgatagattgtccatgtccactgagcagcctgaagtttattggagcttaatgaagtctgatgtttccgatatttagccagaatcagatctgaagcaagataggcaactataccactgcgcgcaatggataaccagcaagcgtaatcttcatggtttatctgtggaaatggatactgtaaggcagtctttcgagtcagcatcaccgttaacagtccaatacgattaccctttagcatttcttgataagttaactgagtttgcgacactttacgctgaccaacctgagtgccatgatcatcaacaacatcataattgcagtacgagaaatcagcctgatgctcctgcataaagctaatctgaacctcgagcttttttggcaaccacatgtcgtcactatctaaaaaggcgacatattgtccttgagcatgcgcaacaccaacattgcgggcattggcaaccccttgattcgctaaaagttgaacgagcttaattctggcatcctgggtcattaacttctgaacaacagccaccgtgtcatcagttgattggtcgtcaaccacccagatttcaaagtcctgaaatgtttgttgtcgtacagattgaatcgtggccggaagataagcggcagcgttatacgctgggacaatgacagatacgcgcggtgcacttttcaaaacgggttttctccttattcaaagcaaacaacgtctgacactaaaattatcagccaccattgtaccatatggccaatcaatctatcactgcaatgacgccacatacttcgccaacccctcagtcagcgacgtatgcggcataaagtcgaactgatccagcttgtctacctgagcatacgagtcacggatatcgcccaatcggggttcttgataagtcgcgtgcagtgttttgccagttaacttttcaagctctttagcgacctgatttaacgaggtttgctggccattcgcaacattaaacacatcgtctcgggcactcggtgtttcgagcaaaccgcgaatggcccgcacaacatcgcctacatagataaagtcacgtgtctgctcaccatcgccgaagaaggtgaacggcttgtcggcttttaacgcatccatcatgattgacaaaacgccgctgtaaggtgatttcgggttttgctttggaccgtatacgttgaagaagcgggtgcagacaactggcatgttgtacagccgcccatagttaagaacttcccgttcagtggcaaatttatccaccgcatattgtgtcaacggtttaactgccatggtttccgctttaggcaatgctggtgaatcgccgtaaacggctgcagagctcgaaaaatacagctttttaaacctgatttgatgcgtacgcaaagtttccaacatgctaagattggcttcttgattcaccaaatgcgttgcatacgggcgctcaacggaatctgccacactggcaattgccgccagcaaaacgatgtagtcaaatttaccgtcaatcagcaaacgggacatgaaatcatggtccgtgatgctgtgttcataaaaagtcacccgatcagagtctggaatattttcccgcagacccattgataaatcgtcgacgatggtcacgatgttcttcgggtcggttaatagcagttcggttaaattggacccaataaagccggctccgccagtcactaagtagttgctcaaaatagtttcctccattatggtggcttcattttcttcattatcgtatcacagcttctgtcatgtcaccgccacttactgaaaatgttagcaaaatgataaaaagcgccgctgtctagcgccgctcctttactgtgatatttttctaagctacatggatcctaattcgactgcacgagccgccgatccaaccaacgacttgccagtgacaaggcatagttgaccacaaagtacatcactgccagcgccacaaacatcgggatcataaagttgatattctgcccgtaaataatttgcgcgtggtaggttgcttctggcaagagaatgatggtggccagcgaggtgtccttgaccagcgagataaactggctgacgatcggcggaatcattttcttcaaagcttgtggcatgatgatgtagagcatggcttgatagaacgtgagcccattgctgcgagcggcttccatctggccacgcggcaccgcgttaataccagaacgaacgatttcggcgagcatggccgattcgaaaatgctcatggcgataatcgccgcagcgacaacatttaagcgaatgccaatgtcaggtaaggcaaaataagtgaagaacaaaatcagcagtaatggcagatttcgaatcaaatcaatcacaagacctacgattgctgaaaaatatttaattttcacgtaacgtgctaggccaagaatcacgcccagaataaagctgaagaatatcgaaacaatcgaaacttccagtgtcacccctagtccttgaagcaggtaacgcaggttaatccatgaatacgcgtcaataaaattatgcataagccctgctcctttctaggcggtgacccattttttctcaagatatcgcatcagataacttaatggcatcgtcaacacaaggtagaaaaccccaacaatcagatacgtatcaaaggtggaaaacgtcgtggcggcgatcagtttgccttggtacatcaggtcaaacccagcaacaaaggcgaggacagaactgttcttgaccaagttgatgaactgattgcccaatggcggaataaccattttaaaagcttgcgggaaaataatctggatcatcgcttgattgtacgtcataccaatgctacgagcgccttccatttgcccgcctggcacagcttcgatgccggcacgcaccgtttccgcgatgaatgcactggtataaatcagcaaaccaatcgtcccagccgtaaaaccatcaattttaacgatgaactgcggtacgatcacgtaaaaagccaatgtaataaccagcagcgggatattccgcactatttcaacgtaaatgcgcccgatcacccgcaaactcttgaatggcgaaatttctaggagtgcgaacaaggtgccaacgattaaactgccaatcaaggcgagaatgctggaagccagtgtgtaaccgacaccggacataaaggttccccagttattggtgagaattgaccacatgctattccacctccttgagactgaagcctggcacatcaccaaaccacttcttaattaacttggcataggtgccgttttgcttaagttgcttaatcgccttattgacagcctgcacaaatggtttttgacccttgttgatcgcaatcccataaggctccttcgtaaaggttccgcctgtgacgatataatttggatcttgttcggacatcccataaagaatgccgttgtcagtcgtgagtgcatcgccctgccctgacttcagcgcagtaaaagcctgcgcataatcagacaactgcaaaacggtggtatctggcgcggcttttttaacgttgtcaacggaattggagccttgcaccccgatgacctttgtccccttcttcaagtctttgacggacttaatcgggctgccttttttaaccaaaatactttggccagcgttgaagtaaacatcggaaaaatccaaaatcttttgacgttctggcgtaattgtcatcgttgcaatcaccgcatcgacgttgccgcctttgatcatcggcacccgagtatcactggtgacctggaccagttgggccttgcctttgctaccaaggatctgcttcgtgattgccttagccatatcgacatcaaaaccttcaattttaccggttttgatatccatcagtccaaacaaacgggtgtcagctttaacaccccagacaatcgtatttgtcgtcttggcagttgttaaaatatcgcgatcggcgacacttttgccgcaactacttagtggcatcattaacaacactaagagcaacggcaggagcatgcgtttccacaattttgccattcaacttcctcctctttaaacgcgatcgctggcgtagaaatctgcgcataaggaacttgatcgtagtggccaaggccatcactttcaaggccgtttatacgccattttcaccgcccagctcacgcccttagtggttaataattttactgagaaattccttggcccgtggttcttgaggatcatcaaagaattgatcgacattggccgagtcaaccagaatctggccgtcatccataaagacaatccgattaccgacgtgacgagcaaagcccatttcgtgagtgacaaccaccatggtcatgccttgttcggcaattttctgcatcacatccagcacatcgccgatcatttccggatccagtgcactggtcggttcgtcaaacaaaatagctttaggtttcatcgccaaactgcgggcgatagctacccgctgttgctgtccaccagaaagctcacctgggaaactgtcggctttattttcgaggccaaccattttcaacagatcatgcgcttcctgctcaacttcttgcttatttcgtttcagaaccaaatctggtcctaaggtcacgttttgcaacacattcttattggcatacaggttaaaatgctggaaaaccatacccacatttttgcgaatgcggttcatatcggttttcttgtcagctaggtcaaaatcattcacgattagttgtccagatgtgatccgctccagcccattgatgcaacgaagtaaggtacttttgccggatccagacggcccaatgatggtgacaacttcaccacgatcaactgtgagattgatattctttaaagcatgaaatttaccaaagtacttattaacgtcatgaaattcgatcattgacatgttcgaggacctccttgggttcactgatgcttatcatggattttacagagaaacttaataatgcgcaaatatttcttattcattatgacaacctttttgctttgaagagcttctcatcgcctttatttgggacttctgagcgttctatgaagttttaaaaggtcttgtgatcactggtatctaaaaccgctcagacgtcagtagctacccttctatgacaaatgaatcagtcctaaaacgttatgattgccttgctaccattcaaaaggacagttatcttgattgcctgccgctggttaatcaccgaactcacactcaaaaaaatcaggccaacgtcacttttgcgtttttagaaaagtaacgtcgtcctgactgtagccttttttcaattgatggcacaactattcataacagtttattcatcgtggcgatgccgtctgctttcgcgagtcggcaagggcttggatgcagcctgcgaggttgacggggctggctcattggtcatcttagcagtttcgcgttggctttcgcgcgttgtgtgtcgtgagtccaaaggctccgcctcatgctcaggctgccgatcaccagtagttgccttgtcctgatacgccaactgcacggttaaactgtaaggttgcgcttccttgcgtaagccgcttcgacccagcagcttctgttcaccaccgatcaaaaagacattcgcaaccacaagatgatagtcacgctgcgccgctttgaccggcaacaaaccaacccgatcaacggtggccagtggcttggccattaaggcattcaagccgcccgtgatgacaagcttactgtctaggtgctgtagatcaaagaatggcaacgggaacggtgcgccaatcgccagaaccggttgttgcgtctcctgtgccacacgaccaacggctttgtcatctagtccttgataattcaaactcagcacaccttgtttaacgaggctatcgacaagcgtatccaaattggcttgctgttcctccgtcatggtgacatcggccgtcagcaattgatcttgtgaaaaaacgccttgggccggtgctgcacccaattgtgtgcgcaattcattttcgacagcggtttttttggcagcgttactgccaagccatttttcaaccttgggtgaaatgtcaaacttggttgtcttatttgtaaaataatataagaagttcaagccaataaaatacagaaagacaacaaatgcaagcataaacagtgcgccgcgaatgcgaaagtccggatagcgcaggttttgaatcgccacatatagtaaatagaagttggcaatgagtgccacccacgtgaaggctttccccttgggtttgtcggcaacgttaaaatagcccaacacgcggttgataatatcaataacagttaacatgatctcatcctttccgcgagttactgaccgccagagccggttgtgtctgtttcttgtccattttgattattattctgctcactaggtgttgttgcgcttgttgaggcagaagcagacggggttgacgttgtgtctgagctgcttggttcctgagttgaagcagccgaactcacggtgctgttatcatcattttgatcttgattgctggtttcagcctgcgattggctagcctctggttgccgcgacgccgaagcttgactcggtgcaacatgtgacgacgcggactgaccagcacgcgaggcagattctgattttatttttgataccaattcactttgctcagtcgccgattttggttggttcaccggattgatcgtgttcacaatgttatatgcactaatcaaaacaatgagtgacacaatcgcagtcggtggtaataatggcggggtacgataagccatgaagccagctcctttcatccatcgtttaattgtacctcaataactagatgataccatttaagttcttgctaagaagacaaggttgccattttcggcgtctttaaatggtggtcatgtctggcctgataacacgctcccattcaaagatggaagaagccgacaacgtacacctaaacgtcttccacctcaactcattcggggcgcattccgctgacgccgtgtcttcaaagcgctgccgcctgcgttcataaaaaaagcacatacatcaacatgtacatgctcgcctgtcgcttaggcatttttaaggcggtctgcatgttgctggcattccgcacacagcccataaagttcaaaattatgactttgaatttttgcacccggcacttgtttctcgaagtaattgaggggacacattttcaactcgatcactttcccacaatttgtacaaataaagtggtggtgatgcggatgctggaaatcacactgtaatttcacaacaatctgatcatcttgcatccggctttcaacaatgcccatctcaataaatgatttgacatttcgataaatagtatcgtgagagactcccggaaattgggtacgcatataacgatccagtatcgtcaccgccgtgtagcgatgctgattcctgccgagataatcaaccatcgattcacgctgcttggtcacgcgataaccgtgctgtttcaattcttctaatgcaatcgttgtgttatccatgcgaactcctttagcttgacactttgattaatggcgtgtagactattaaatcgtattgattacgattaatcaatcattagtgtaccacgcaaaacaggaggaagcaatatggcagaaaaaactgactacgcatccgcagcacggcggttgaagagtaaaaacccgaaaacccgttcacgggcaaaacgcgtgattaaagccgttaagaaaccagtcaagtaattttatcgcattattcaaacaacatgtagcaaggcgcgagcaccggtgatcatcacggtggctcgcgccttatttttgttctaaatcgatgcgggcaaggccgcaacttttcaaagccaaggttttcataaattgatccacttgctcgcgcgcctcatcccaactgtcatttttgatcacagtggcaaacggctttagttcgtctggcaaggttaaatcgcgtttatattccggacttttcaaccgtgcagcaaccatggcaggatcatcaccacggctcaacaaccgatcttttaataccgttgggttatcaattgttaaaaataagaccacgacctcctttggcaactcacgcacataggtaatggcaccttttgtgtctagaacaatactaaggaagggatgcttggtccagtttttttcaagcgattcatgggaggaaccgtactcataaccagcataagtgactttttcgataaaatgtttggtcgcaaaactcgccggtgtttcgaaatagtaatcgaccccattcttttcccctgtgcgcgccggacgggtggtgtgcgtcatcacgcggtggatgcgataattatcgcgaagataaccactcaccgtcgttttgccagtccctgttgccccagtgatcacaatcaacttatgcgcagctttcatgatcagcctcctcttaaatgattgcctcgattgtaccaaatcagcgcggattagtcagcttgaaaacaggttcattgattcggtttatcaataacgctgttgccaactaagaatggctaatgctgatcatgataaaaagcaatcacgcccatttgttgactctccacaaacccagcggctttataaaagcttcgcgttttcggatcatcgtccgtcaataaaacccgttgccgcacttcagggaaccgcgccagcaaagcttctattaattgtttgccgatacctcgacgctgatattctggcaaaaccaacagatcctgaataaaaagaatggtttcgccgtcaccgactgcccggattaagccaactaactgtttgccctcataggcacttaacaccgtcaatgaatgggtcagtgcccgttcaagtcgcgcaggatcgcgagtatacatgctccaaccgacacttttataaagtgccaaaacctcgggcatagttggtttttgatcagtaattgtcaccatggcgtgtgtcccctttataaaagaatgttttccttagagtagaaaaaaagatcgatcacgcttgatcgacctttcaaatgctattgcaggatgtgaacgatatttttacagacgacgaccgaagcttggtgcgaagtatgccatgctctgaatcgtaacgctttgaccaggagctggtgcgtgaagatattggccactgccaatgtaaataccaacgtggtaagcactaccaacgccgccccagaagaccaagtcaccggcctttaagtcagaaacggaaacgtatgagccaagcgtactttgagcttgcgaagtccgtggcaagctgatcccagcttctttagctgcatagtagatcaaacctgagcagtcaaagcctgatggtgaagtgccgccataaacgtacggaaccccgatatacttagcagcgttgctagcgatactgccaccggaaactgaaactgagctattgtttgaagcaggtgcctgtgaagcgctggcgcttgaagaagcactggtggtgctggtattggtgctggtgttaacgctacttgatgctgcactgcttgaggcggtgctggttgaagaagcagatggtgttgcggcaacagcagcggttgctgcggcagctttagcagcatcttcgctggcagccaactgagccaacttatctttgttagcttcaagtgtctgctgtaaatcggatgcagatttttcagcatcactctttaagctttcgattttagccttgtcgctttccaactggctctttgtcgcaacaagtgtttcttgcttggcttcttgttcagtttgcagggtcttaactttggcctgtgaatccttaaccgcctgcaatgcttctgcactggcttggctaagtttgttgaccgtcagtgaacgaccaacaagatctgtaaggctgtttgaattcaaaacaaagtcaaaatagacattgcctgtaactgaattaccaacctgcttttgcaatgaaatcaattgttccttcagattgtctttacgcttgctgacttcgacttgcgccttagcaatttgctggttgtaagaggcaattttagcctgactagcactaattttttcttcagcattcttaatgtctaatgctttgttagaaacatcattgctcaacttcgcagttttttcatttgccgtttggatttgcttgagcaaggcatcattcttggcagtcaagctagacttatcgtcatcagctttaactgttgtggcagccacccctgaaaccccaaccccagccaatgttgcaactgtgataaagcctgtaactaattgctttaatttcatctttatcgtcactcctgctttcgttttgttcacaactgctacattaacactggactgttacagtctcgttacagcatgtttactatcagaatactttcttcaacatattgtcatggtcaaatataaggaagttcataagaactttttatttcggttattttcaagaagaaaaggagagtcgaaggtaccaaaaaaaggcctgtgataaacgtttgttttatcacaggcctaaatcaccagtcgtcatttttattaacttttattgtttaatagtaaattggctataccaatcatgcgacttaaagggttactttgccgccttgatatcgactaaaaagtaccgctttttaccacgccgaacgatgacatattggccatcaaaatgagtgctcggatcaacctcgaaatcgagctcccgctgacgtataccgttgatcgtgatcgcaccattttgaatgtcttcgcgggcttgacggcggcttggttcgattttggtagtgtcgactaaccaagtcacaatgttttctgcggtctccggtgcctcaactgttggaaactgcttgaaaccctgcttgatatcatcagcgctcagctcagcgacatcaccggaaaaaagggcagcactaatgttttcggcctgatcaaccgctttttgaccgtggacaaactttgtcaccgcacgcgccaattcacgctgtgcttcacgtttttccggatgtgtcttcgttgcttcaaccaattcggcaatagcatcgcgcgacaagaacgtgaagaacttgaggaacttctcgacgtcggcatcatcctgattgaaccagaactgatagaactcgtaaggtgacgtcttctccggatcaagccaaacggcgccgccagcagacttaccgaacttggtaccgtcagccttcaacatcaatggattggttagaccataagcacgggcttctggtccctcgatgcgatgaatcaaatcgatcccagccgtaatattgccccactgatcggccccgccaatttgcaattgaacatcttcgtgtttgaacaagtgcaggaaatcgaccgactgcagaatctgatacgtgaattccgtgtacgagatgccgttttccaaacgactggcgacgacttctttatttagcatactgttaacggaaaaaagcttgccataatcccgcagaaaatcaagcatggataatttcgataaccagtcataattatcgacaatccgaaaatcatcggttccgaataggttctccatttgggcgatcaatttctttttatttgcagcaatcgtgtccatggtttgcaagacccgctcggaattacgcccggatggatcgccaatcgagccagtgcccccaccaatgacaatcacgggacgatggcccagaagttgaaaccgtttgagaatcatgaacggaatcaaatggccaacatgtagtgaatcaccagtcggatcggtgccacagtaaacactgactgctttttcctcggtcagtttccgcagaccatcttcatcggttaattgattcaacgccccacgccactttaattcgtctaaaattttgcctctgtctgtcatgttacttgttcctccctaaacacatttgctggtacagcaaccgctgtataagcgccttggggctattatggccaaaaggcgcttacattaaacttttaagcacgccagttcacgctcttgactaaaatttgtctttgccagaatttaccgctacctgtgagctgagatgcaggatggcaacgtctagatcgttggtcaaggtcattcacaatggcataaaaaaagcccctgatcttcaacgatcagggacgattttcaccgcggtaccacccacattatgctttgcatcactctaatggatatcggcatgacccgttaaccaggctttcattgaggtgtaattcgtgatcaaaggcggaacggtttgcagcaaccaccgtttttcttagacctgcctaggaccactactgcgactcatctggtgactttatggtttagatcttaacacatgtaggcgaacggttctattctttttggacattcttccggagttcgcgctaacgacgcagtacttctgaagtgcgcctaacttttcacttttgcgggtcctgtggtgcttcttttggatctcgatcggctggataggctttgacgtcagcgtctagaatatcgtattcatccatgagtctgcgttcgacgcgctctcctagatcataggaatcggctacggtcatattgggattgacacgaataccgatggttagcaagacagcatcgcctgcatatcgtgcttcaatactttgaacgcctttgacacctgggactgcactgatggtttggcggtaggcagcaatttttttggtgtcgaatccatctgttaattcaaaaatggattctcgcaggatagtccaagccgcatataaaatcaaacaaccaacggccacagctgcgccaccatccagccaaagccagccagctttggcacctaagatggcgagtaacgtgccaccgctggtcacagcgtcggcaaagctgtccttggccgacgctcgcaaaacactgctgtccaattgcttcgccctaatatggttaatcagtgaaacggtgcccattgccaatcctgccgctaagctaacataaaccgcaagttctccgggaacctgcagcttaccttgataccaagcttgcagaccgtgataaccgtcaatgacaacatcaagaccgacgacgagcatgattaagccagaaaagagtgttgcgatggtttgaaagcgccagtggccaaatcggtgttcactgtcaggccgttgttgggaaatctgcaaaccccaaagtaaaatcagcgcagaggccacaccagtcaggttattcaacccatccgcagccaatgcccgagaatgagctaactgcgcgatccacaattctgccacggtcaacccgccatacacaatcagattcagtgcagcagcatgctgggcacttttcagacgggcaaaccggcgttgttcatcttttaaaatatttcgaccagcatccatgcgatatcctcctgactaaattaatttgtttattaaagactattataattcaaataacgcaccagtgactggttataactttacaaaaggatagtgagagcgctttcttacaaaatttttcacgacaataaaaaagcccagcaatagccgggttttatcaagcatcgttcatatcagccgttttcgttttgccgcttcaaagcgcttgtcaatcgttccaatcgagcaatggtgtcatctaaggtcagataataataaaccatattgccttcgcggcgtgagccaaccatgccaatgtctttgagatgcttcagatggtgcgaggtcgctggctgtgacaaaccgatagcatcagccaagtcgttgacttttaagcctgtatcattgtctgccgttcccaaaatcataatcaatttttgtcgacttgaattcgataacgcattgagatgtccaatatcttgcttaaactcttttaaagcctcttgttgcgcagagctatatgccgccattatgatggcctccttataaacgcgtttacgattgcggaaacttgcgtctttagaacacggtatgcatcaaatttcactcataacgaatattacctgaaatcgtaacgattgcaaccaatatgcaaaccgttcatactgaatgcatgtcaatcgattatttttggaggtgccaatatgaccacgacgaccacttttcatggtttgggtgcggataacacgcttaccgtttatgcagatggtgctaatgaactattgaatcaaagcatcagcatgatcaatgcttatgcccatttgttatcgctgtatgatgaagcatccctgctgactttgatcaacaagcaggccggcaaagaaccggttcacattccggttcgccctgtgttcaatctgattgctcaagcgatcgcctggagcaaacgcggattaggttacaacgccttaatcggcccgatcgtcaaactttggcgcatcggtttcgatgatgcccatgttccgactgccgaagaagtcactgccgcgcttgctttgacagatcccgatcttgtcgagcttgattcagaaaatcaaactgtttttctgaccaaacccggcatggcccttgatcttggcggtatcgccaaaggtttcattgtcgatcaagtctatgatctttgggacaaaaccggcgttgaaggtgggttgattgacttaggtggtaatcagcggctcgtcggtaatgcagccagcggcgtaccgttatggcagtggccaatcactgacccgcggacaccgggaaaacgcagtatcgccaccttgacaaccacccctaaagccgtcgtgacgactggtatttatgagcggcactcagagatcaacggcaaagaatatcaccatttgattgatcctaacacaggctatcccgtcgaatcagacatggccagcattaccgtcgtggccgatagtggcctgatcggtgatgtgttatcctccattggattctatgctggtatccctgccggttacgatgccgttgaagccgagggtgaggaagccatcttcgttactaaagatacccgcgtttaccaaaccagcggcctgcgcgaaaccttggccgtcaccatgtaaaccttagccaccgttgtcttcagacataatagtttgggacatcactcataatcatcaaaaaggcaaacaaattccactgtaaagcggaaactgtttgccttttcttattgtaatctattggaattttaaagatattagtgccaaggcggagcaatcgtaggccagatggggctcagccgtgcaaacaacacagcgaccgggctttgtcgctgatgttgttaggcgacttcgagaccgatttttgggctcgaagcgccgtcacagcgttccagccccgtctggccggagattgcggagtttggcacggcatgagactctttggcctagaccttaccccccgattattcagaatctaataaatcacaaacccaatacgacaattatgccccattcttttatgccaaaatgctataacaaatcacagcattcataacaataacataagcgttaaatctgctgccaaatcacaccgcctgccggtaccatcgtgcctactggcaataaagcgcgcaaactttttggcactaattcagcatgcggatcctgtaacacttgcggtgatccagttggattggccagaactaccagcgtttgggtatcattttggcggacgaagccaaaactgtcttcaaacgtaaatgggaaaaaagcggcacctgcagccaaggctggctgatcaatgcgggtctgaagcgcgatttgataaatatccaaaacagcctgatcttcatggccccacggataaaaggcgcggttatccgggtctttaccgccagttaacccggcctcatccccgtagtaaaggcacggcaccccaggcagccagtaaaatagcgagacgataaactgcaacttacgccgatcaccatccaacatcgttaaaatccgtggtgtatcatgactgccaatgttgttgaaattgaacgcaaacgcatttgctggataattctctttcaacgtcatcaattgacgcacaaatcctgccgcgtttaactgcccatttgtcaggtcaatcaacatggatcgcagcggataattcatgactgcattcaattcgccgccttcaaaatattgccgccgcttgccataagcctgtttattggaggcatcctcccagacttcgccgatcagcacccgctccggaaattgatcaagcgtgctgcgaatctgccggataaaatcgtccatcaattcatcggcaacatctaagcgccagccatcaacgcctaagtcagtccaataactgatcaccgaaccttttttagccgcaatgaagtcatgaaaatcttgattatccttattaatggctggcagatccttcacgccccaccagctattgtagtcatcaggaaatcgcttgaatgaaaaccacgaggcatatggggaatccaagctattggccgcacccacgtctgaatattcattgacggcattgaagtagcggctatcagcgccgacgtggttaaacacgccatcaagaatgacatgcatccccaactgatgcgctgccgccaaaaactgcttaaagtcatgcagcgaacctaaaacttcatcaattgcgaaataatccccggtgtcataccgatgattgctccgcgcctgaaaaattggacttaaatataaggcgttgatgccacgggctgccaataatggcagcttttgttgaatgccagtcagattaccgccgtaaaaatcccagcgaatgatatcgccatcgttcccgcgaatatacataggccgatcggtttttcgcccatacagaaaagagttttccttcggagcattcacgtgaccgtcagcattcccattattaaagcgatctacgaagatatgataaaaacgggcattttgataccacgccggaacgggatcaaatgcggtcacaacggtcatctgataattaaccacatccacattttccgggtaaagctgaccaagcccgccaaagccaccgccgactgcaccaaagcgttcccggccattgtcgctttgcaactcaaaatgataaaaccaaaggccggcattaggaggcgtaaacgtcactgtgtagccgttagggcttttcgtcatcggcaaggattgcgtttgatcgcaatgttcgtctggcatgatgacaagtgtggcttgtgtcaccgcaccatcagcctgtgccgtcaatgtcacagccgtgcctttttgcaccgcgccaaaaggtcggcgatcggtaaatgaatcaaattgaaacattgtgttcctccatgtgtcatgtacacgaaacgttctcaaaaccgataaatgaaccttcattaatcacgcaaccgatagctggattgataacaatgagcgccaaggcatgctgatcagatgctattctacgtcgagtgtttccgataagtccgagctggcgtcgcggcgattcaggctggtggctgcgcggccaactttctgcatgttatctaaaaaacaatcaccagaagtagcctctgtatgaccgctttaagcctcgtgatcatcttctggtgtctttgccaccacatgccaaatctcgcgaccataacgttgaaccgtaaagtcggccgagaatcggccactttcggcaatattagccaacgcctttttggcccaaatgcgcggttgttgataaagcttatccagtctttcgttcgcagccagataactttcaaaatcggccaacacgaagtattcatcgttgtaagtcaacaacgaattgaaaatgtcacgaccttctgtttcaatccccgggatctgcccattgaccagcatatccagtgcggcgtgcaagcgtggatcttgatcgtaaaagtcgcgagcatgataatcgccacgctggtaataaccggcaatttcttcctctgtcaacccaaaaatctcaacgttgtcatcacccacggcatccttgatctcgatatttgcgccatcaagtgtcgccaaggtcaaggcaccggcactcatcagcttcatgttactggtgccgctggcttccttaccagctgtggaaatttgctcagaaatatcggccgcaggaataatcttttcagccatggtgacaccataattcggcaagaaaacaacttgcaagtacttgctgacatctggatcaccgttgaccaaatcggcaactgcattcataaccttaatgatttccttggcataaacgtaacttggcgcagctttagcgccaaaaatgtgcaaacgctttggtcgtttttcgccacgtttgatcgccaagtaagcatcgagaatccctaagacatgcaataattgccgtttatacgcgtgcaggcgtttgatctgcacatcaaaaatggcatcaggatcaactttgacatgcacaatctgatcaatatacttcgccaatgctcgtttattttcggccttagcagcattcaggtcgtcgagaaaccgggtatcatcggcgaagtcatgcaactgccgcaatgccaacgggtttttccgccaagttgtcccaatttttttatccaaaaggtgggaaagcggtcgatcgccaatttgaatccaacgccgcggcgtgatgccgtttgtcttgttattgaaccgttctggaaagatttgatacaagtcatgcaggacgtcttttttaagcaactcactatgaattggggccacgccattgatcgcatgggaaccaattgatgcgagataggccatccgcacctgtccgttaccaagcggtgcaatccgatcaatcattgcttgaccaaattgcggcacgaaaaccagccggaagcggcgatcgatttcctgaatgatttgatagattcgcggtaccatgccgctgaacatgtcgattggccaaacttccagcgcctctgacaacaacgtatgattcgtgtagctcatcaccttgagcgtaatgcgccaagcttcgtcccagctaacatgctcatcatccattaacacccgcatcagctccggaattgccattgccggatgggtatcattgatatgaatggcaacgcgatctgcaaatccggccatgctgttatgggtacggcgatagtgccgaacaatactttgaatcccagcactggtaaagaagtattcctgccgtaatcgcagctgcttacctgatgcatcggaatcgtcaggataaagaatctgtgtaatctgattgatccgttctttttgttccaacgtaaaatcggtgccggcattgatcggtgcttcagcagaccacagacgcaggttattcaccacctgattgtggtaccccaccatagccacatcgtatggtacagccaatacatcgtcagtattgtgatagatcacccgcagattgccgctacgacttgggcgtaactcaacccagccgccgaatttaaccgtgactgcgcgattttctttacgggtttcccacgcaaaaccattccgcatccaatcatctggcagctccacttgatagccgttaacaaatgcctgcttaaacaagccatactggtagcgaataccattgccgttgccagccatgccgacactagccatggcatccataaacgctgatgccaaccgacctaaaccaccattgcctaaacctggatctgcttcagcatcaaaaattttctgcggtcgcagtcccaactcattcaaccctgcttcaacttcactcagaatgccaagatttagcaaattcgactgcagcagtcggcctggcaaaaactcaattgaaaagtagaagacctgttttgtctcctcctgatcgtaacgtttcttggtttcggcccaaggttggccaatatatgaccgcgttaatagtgccaacgcctgataaagctgttgggtggacaggtcatcgagcggtgctgcatacagcttcaaagcaatatctttgaattctgtaatgaattgttcctttgttaatgacataaacacacctcaccaaattaaatacagcaacttttaaacgcaacgcaccccgggagtgacaccatgtcgtcgtacccacggcgactccaaaacgagccgaaactcattttgataaacaaaacgaggtcggatcgggtcaccttgccagccggtttgacgcatctacgcctcgcctgccttccgactgatcccgacacgacctcgctgttgtcacctcatgctttgcccagaatgcgttgataacctttcaaatactcagctgcggaatggtaccagtcaaagtccttcaccatcgcatgttgttgcaacttagcatagacttttggctgatccgcataaacactcttcgccatgcgcagaatgtttgtgagcacgcctgcgttgtaatcccagaaactaaacccatcaccagcgccagtttcagcgttataggctagaactgagtcacgcaaaccaccagtttcatgcacaattggcagcgtgccatagcgcatcgccatcatttgtgccaagccgcttggttcaaaggcgcttggcatcatgaagtaatcggcgccggcataaatccgctgcgctaagccttcatcaaaatcaatccgcaccgccaattggccagggaaccgatcctgcaatgatgacaaatcttcttccagatcttgatcgccagtaccaagaaccacgacctgtacattattttgaactaagaaattctccaaagcatcaactaagagatcggcccctttttgccgggtcaagcgactgaccatcgcaaacagcggatcagtcctttttggtaaatgcatctcgtcttgcaaagcctttttatctttggccttgccagataaattcttggcgtcgtaattataagccagattctgatcagtggctggattatagacttcagaatcaatcccattcagaatcccgaccagtttaccactttgttttcgtaacgtgccatccaaatgctcgccaaaggctggtgtttgaatttctttggcgtaactcgggctaaccgtcgacacaagatcggcgtaattaatcccgcccttgagccaattgattgacccgtcttgaccaaagccatcgtcgttgaaaccttcacggccaataccaaaaacggtcgctaacgttgacggcgggaaccagccttggaattgcagattgtgaatcgtcagttgtgtcttaatctgttgatacggcttgatccaaccatacttttcttttaatagcaccggaatgaaagctgtgtgccaatcgttggcatgaatgacatctggaatccattcaatcacctgaagcatttcaatcacggccatttggaaataaccaaaccggccgccgtcatcccagtaaccgtacaagccatctcgatcaaaatactgccgattatcaatgagatagtacgtgacatcccccagcttaatcgttttaaggccaacgtaaactggacggccatccatctccaaggtgaaatgggtcaaatccttcactttaggcagatacttcgccgggaacttcttttcataaaatggaatggcaacccgaatgtccacaccttgcttcttaattgctttaggcaaggcataggttacatcccctaaaccgcctgttttataaaacggcgcactttccgcagctgtaaagagtactttaagcacgggccgtcaccccctggccatctggctgaaagactttctgattcttcgaaaagaccaatggctcctcaggggtcccttccaacgcaaggtttggcccaatgaccacacctttgtctaggatcgcatacttcacactggagcctgtgccaatcttactgccttgcatcacaatactgtgatcaaccactgcatcacgatgaatatgcacatttctgaagagaatcgaattatcgaccgtaccttcaatgaagtcaccagtacctaacaagctgttggtcaccttggattcggttgaatagaaggtcggaatttcattcttattcttcgtttcaatcgaattagcactataaagcaacgcttgatagttttggtcttccaacatgctcatgttcgcgtcaaaataccgctgagtcgtattcagctttgccagaaaaccagtatattcaaacgcgttagcattattttccagtacggcttcacgtagaatttgcggcaaccgtttgaatgttggcgcttcggaggcatccgtcagaagatcaatcaagtcaatcgtcccgatcagataaatatccatgaacgccgggatcttaccttccttgagatgcccacgatttcccgatgctgggacaactgagctagccgtgccaagctccgtcatatccaacgttaaatcttccggcttcatcgcttcttccggcaaattcttgtaaaccgccgtcaccggactctcgccagcttggtgataggcaacgatggcatcgacatcgacattggccacattttgcgtacccatgataatcgtgtactgcgcgctgcttttgcgcagaaattgcagatagtcgtcaaaataccgcgcacgtaattttggatcttcatagtcgcggcctgccatatacggatacgtgaaaataccaccagtaatctgatccatgttccaagtcgacccgctacgaatgtggtccgtgacactacgaccggactttggcaggaaaatcgccacgctgcgaacattggcatgatccaatgatgacagtggaaaatcgatgagacggtagcggccagcaaacggcaaggtaccgatcgggcgggctgctgtcagcggctgaatttggtcgtctggttcattcagatcaataattgctgctaaatcgccttttctcattctttttcagtccttcctaaaacttccccataaccaacaacgctaatttcattcggttttccgacaactttaccattgtcgccaataatcgcattttcaccgacaatggcatgatcgacagtcacattcttaccaatgacggcgtttggcatgatcatgctgtccttgatcacggaaccctcaccgattttgacgttttgactcaaaatgctgtgctgaattgaacctgcgacatagcagccgtcaacaatcatggagccagcaactttggcggtcttggtcaggaacattggcggcagcgcctcgttttgactgaagatccgccagttgcgattgccaatgttcaatggattgttaggattcaagaattccatgttagcttcccacagactctgaatcgtcccgacatccttccagtaaccgcggaaggcataagcataactggcttcattatgcgtcaggtaagctggaatcacgtcatgaccaaagtcttccatggcaccatctgttgcataactttcggtcaaatattgtttcaatgtcggccagttgaaaatgtaaatccccatcgaggctaagttactctttggcttggctggtttctcctcaaattcaataatccggtccgtgtcatctgtgttcatgatgccgaagcgtttggcttcttctttttcaaccggcatgacagcaacggtcaatgaagccttcttggccttgtgataatccagcatcgcttgataatccattttataaatatgatcccctgaaaggattaacaaatattgcggattgtacgagtcaatataagcgatattttgataaatcgcatgcgccgtgccttcaaagaacttttcgccttcacttgaagcgtaaggctgcaggatggtcacaccggcaccgcgttcattaagcccccagctggcaccattttgaatatggcgattcagctcaagcggttgatactgggtaatgacccccgcggtgttgacccctgaattagctaaattactcagagtaaaatcaataatccgatatctgcctccgaatggcaccgaaggcttagccgtcgttttggtcagtttccctaaacgggttccctgccctccggctaaaatcattcccaacatttcagtactcatgattgcggcgcattgtgcgccttccccctaacttcttcgattgctgatggttaactttgctaatgtcacgtggttgcgaacgcgctggcgatgtaccccagtcgtcttgatgactaatcggttgccgttgatgaccggcgagtgacaacggtgtttcgtgtttcggtaatgccttggttggctgcttgcctttaagcgccaacggttttttcggcaacggcttcagctgttttggtttaatcaacaaagcgcccatggctggtaaaatgacgtcaagccatgcaggaacgtcatgattttcgccaatctcagcagtcaaggtctgctgccacttggtccatgtaccgccaaaagccgcatcctcagtatttaaaataatctcgtacgttcccggactaggaactggcacgcggaaatgatctttttgaactggcaccagattcatggccactaccgtaaagtcatctttttgtttgccataacggatgtaactcagcacatccggttcatcggcaatcgtgattttgatgccgtcgggttcatgatcttgttgccacaaacttggccgagctttataaagatgattcagtgtggtggtgaaatgctgcatcttcttattcattgggtctttaagatcggcccattccagctcgctccagtcgcgccattcaagaaactgcccccactcgctgcccatgaataatagctgtttaccagggaatgttgcctgccacacatacatcgtccgaagattagcaaactggttataccgatctcccggcattttgtgcatcaggctctttttgccatggacaacttcgtcgtgtgaaaacggtaagacgaattgctcgttatacatatacatgaatgaaaacgtcaataagttcatatcactgtggcgataaaccggatcctgctcgaagaacttcagcgtgtcattcatccagcccatgttccacttgtagttaaaccctaagccgccagtatcaatcggtgcagaaacttgcggataggcggagctttcttcagccatcatgagcacatctggatgtttggcaaaaatctttgtattcaattgcttgataaaggcaatgccttcaaggttgtcacgcccaccatccttgttgcgatcgttttccttgccagcgtcataatccatgtacaacatgttcgagacagcatcgacccgcaggccatcaaggtggcagtgatccaaccaatacatcgcactggaaattaagaaactctgcacttgtgccttgccaagatcgaagttccaagtcccccagcggacattttctgcgcggtgcggatcggtgtattctaaggttggcgtgccatcaaattgggccaacatatcggtgtttttgataaaatgccccggtacccagtccatgatgacgcctaatcctgctgtgtgagccgcatcgaccaaccgcaagaagtcttgcggatcgccgaaccggctcgtcggcgcgaagtaacccattaactgatagccccatgaagcgtcaagcggatgctccatcaagggtaaaaactcaatgtgggtgtaacccaactcctgcacataagggatcagcttgtcgatggcgtcttgatacgtcatataaccgccatctggaccggcatttgtgtcgcgaatgaaggagcctaaatggacttcgtaaatattaagcggttcatcatacggacgccattttgcccgcttggctagccaatcttcatcatgccaagtaatacgcggcacatcgaccaacttagccgcactgcctggcttgcgttcaaacccaaacccgtatggatcaatcttctcatgggctatcccatcaggaccgataatccgatacttgtataactgatttttttcggctgcaagctcaccgtaccaacaaccggtggtgccttgcagtttcaacggactgccttgccagtcgttgaagtcgccttcgacgttgacttgttgggcatgcggtgcccaaacgaggaaggaccacttgcctggttcgacttcatgggcgccaaaccgattgtaactttgaaaatcttgcccggagttgaagaggtataaccaatcttttaatccctgaatcataatcactcccccaatcaaacgataccgtcgtacatgtgaaggcttctcattcactgtacggccggacttttacctaccaaatcaagtgtaacagtaagactatcaaaaggctcaagaaacgctcaccaaaaaccttcacgcacgccaacataaattttttgataaggcatatactcccggtcctcgtctcaattgtaaccgcttactgttaatattaacagtaagcggttacaatcttttctgttgagttctttgtgagaatactctaacatgataggtatattatttaatgaaaccgcaatgttcacgcaacgttactctgaaatcaacctcagccggctgttttcagtcagacgcacacaaatactggaggtactgccatgagtgtcaatattgattggaacaatctaggcttcgattatatgcaactgccataccgttatgttgcccactggaaagacggggcatgggatgaaggtaagctgtccaccgatcccaacctgacgatgaatgaaggctccccgattttgcattatggtcaaggcgcttttgaaggtatgaaggcataccgaaccaaatcaggaaaaatccaacttttccggcctgaccaaaatgcccatcgactgcacaattctgctgacaaactactgatgccgccatttcctgaagatcgctttattgatgcggtcaagcaagtggttgccgctaaccatgaatacgtaccgccatatggcaccggtgctaccttatacttacgcccgattttgattggtgtcggtcccaatatcggggttgctccggctaaggaatacattttcgatgtcttcgccatgccagtcggcccctacttcaaaggcggcatggtgccaaccaagttcatcgttgccgatcaattcgaccgggcggcgcattacggcaccggccaatcgaaagtcggcgggaactacgccgcatccttgcaagccggcaaatttgcccacgagcacggttatggcgatgcgatctatctggacccaattgaacataaatatattgaagaagttgggtcagctaacttcttcggcattagcaaagatggtaaaactttgaaaacaccgaagtcaccatccatcctgccaagtatcaccaagtactcgattttggcactggcgcatgatcggtttggcatgaccactgaagaaacgaagattgcgattaccgatttggatcaattcggtgaagccggggcctgtggcactgcggcggtcatcaccccgattgccagcatcacctacgaagaccacgaacatgtcttttattcggaaaccaaagtcggtccatatacacagaaactgtatgatgaactgacgggtatccagtttggcgatgtaccggcacctgaaggctgggtcgttgacgttccgtttaattaatttaaaaatcatttatcactcggaaactgtgagttcttgcacgcgctataacgcatctgcaatcgcgtacgcccgctcacgcttccacaaaaaaagcagctgcccgttttaccggcggctgcttttttgtgaggaaagtcattttgcctaattcaacaatataacagtcaatcaattcaaaacttactaagcaactttacgaaaaagcctggaacctgacaacttgaaattgaaagccaaaaaacaatgatgatcactcaacagccttaacgtgcaaaggcaatcaagcgccagtagttacctacgcaagtttgtaaggtaatgcgctgaccgccgccagtacccgtgattacgttccataaatcttgtccactggcagtgacggcatttggattcactgtcgccaattgataaacatggtacgtgcgcgggttaccagcagcgtcggtcactgtgatcggcgaaccaatgccaagtgatagcatcgcggcaaaagaaccaggattgtggccaataaaatgcgtgttttgaccactattgttactataatttgcttgaccgccccacgttgcagctccagtgcccggtgctgcagtcatactttcatttccaatgatataaggcactgtcacaccttcaaacattaggacgcggctcgcgtaagcaggtgcttgctgtgcttgcggttgtgctggttgttgagcaggttgagttgccggttgttgcgccggttgttgttgcgccggttgggcagcagtcgcggtttgtgctgcagacggagctgccgatacagtcacttcggcagtagaagtcgaagcccctgtatttgaatcagatgaatcagaagtagcaacagcttgttgactagccggtgcgcttgaagcaacggatgtacttgccgccgtctgtgatgatgatgtagcagacgttggtttagtcactgaaacagtgcgaacgctccattgcggatgtgctgcagcctgtgatgcaggtgccttggcagcagtggcatcgagcaaatcgttagaactacttacagcattaactttctccctcgtgcttgtgcgcgatccggccaagtcttgacgctgaatggtggtgcctgctgcagtggtgataagcagcccactcacgacaagagcgaaagtgatgagacttctgcgtaacatatagactcccccagtccatatcggcaaaatgacttaccacatattcttttcgagatggccatctcatgcttttcattatggcgcattagttttgtaggtaaacatatatgcttaccgattgtaagtgcttaacgttatttttaagttaaatgatccttatttcatgcatttatcagtgtttaacgccatatttgctaaacattcttttcaaaagttggttaaaaccgttagcattcaaaacgagttttgagattcggttttatttacacgcacgtttctaaccggactggatcgttctcctcaaaaaccgactcttgattatgaaccatatatgattcacaatttagttgtcacctgttgttaaggggagtcatggtaccaagttcaaatcaatttaagtttgtatgcggtgataaggaaattgttgcacaaaacgccagagaagatattttagaacttagaaaactgcttggcctgactcagagaaataacagggaaagcacattccagtagaacgacggtgttccgcattgaacgtagcgttgttaatcgtaccgttcgctataccacagaactgcacttcaaagtaacggaggagaagaatgaagacaacaattaaggccgctggggcagtcattttatcaggattgcttctaaccgggtgtagcggccagacaaaagcgtcacaggctaaaccgtcagtagaaccgcaactggcggtgcttacaaagcaggtcaagagtctttatgctgatagtaaatatgagatgcctgccaaggatctcagcaaagtaggattgaccaaggcggacaaccaaaaggccaaggtgtataaactacgcggggagctctcaaaagctcaacaaaaaactttcaaagtgaatcagcagcagctcaccgcagcaaaacggattctctcagttcaggacacactcaacgttcagttgggcaaagatcaagtccttaaaaatgagaatttgaaggttcaggatctcaatactgattttacatatctcaaaaaaaataaagccgtgtttgctaatacgatccaaggcaagattgaattactgaataatgaagttaaggcagtgagtctcgtcaaagcagccgttgcaggtgatcccgatcaagcaaaaattgaccaggcacgtgatgcaatcaatgctgttaacgtcaaggcgttcaaagagaagtatttgcctcaactagacgaagcaattaaaaagttgccgaaggagcagcaagcggaacaggctaagaaacaagccgctgcgggcgatccggaacaagcttctatagcacaggcagctgcttcatctagtagcagcgtcccagcagcaagtagtcagggaacaacccaagcggcagcggccaataacacaacgagcaccggtgctggcgcgcaaaattcggccggtggcagtagtaacagcggtgcttccaacaacggcggcagtgcagtacagccaagcagcagcaaagtgctcggcgttcagtttatcagtcaagaagcagccggcgcaccgatgggttgtgaggctgcgagtgccctagaagcgttgcattataagggacatgcagctggacataatctggcgacattcctaaagacgatgccaattgccgcgaatggcaatccttatcagggatttgggggtacgccttatgccgtggtcgacggtgtttatcagtcaattttcccaagtgcattcacgccatgggttagtcagtttggcggtgcaagcaatatcagcggcagtagcttagacggcattatcagccaagtggctgccggcaacccagttgttgcttgggtgacattgaattatcaaggtccacagtggcatcattatgattggggtaacgggatcgataatgcgcatgttgtgacagtggatggctacaatgacagttcaatgcacattgttgatccagagaatggtacttactggatcagtaaatcggcatttaacgcagcttatagctacatgaaatttgcggtagcggtacaatgacatcatagatattgaagaaatgcagttgattcagaatggctatatccgtttagtagaattacccaacatctggatatttattgaagctggatataattgatagctatcgaagcaaaacaaacagttttcctaaacagcggaaaactgtttgtttttttatgggtgatttattggggttttaaagctatcaatgccaagacggagtaatcgtaggccagttggtaatcaaccgtgcaaataacacagcacccatgcttgaggctgatgttgttaaatgacttttagatcacaggctttgcaggctaaaaacgccgtttccgcgctatctccatgtcgcaagcgccatctggccagagattgtggtgtttgacacggtgaaaaatcttctatccagaatttccttggattatttgggatctattgaatcacaggttctaatgaatcacaggttttaagggacaattatggctaacttttttgcttgaaaagaggtagttgttaggaaagcacctgttaaaagcgcataaaaaactgcgacaacgtccgaattttttcgggaacgctgtcgcagtttaataccatgatgaagcttaaatactgccgccatgaacctcagttgctgccatggtcaagatgaaagcattgggatcaattgcgtggactaagtcaatcagatggcggaagttggcttgttcgaccacgaccatcaacatctccttagactcatctgagaaaccgccaacgacgcgttgcaccgttaagccatgcggcgtttcgtcgcggacttgctgtttaatcgtcgccaactgcggactcatgatgtaaactgcttttttccggtcaaaaccggtttcgacataattcatgaccagtccggtaatcgccaaagcgaacacggccaagatgaaggcctcgacgccggatacggggatgttaaaaagtgacacgatcacatcagtggctagtagcatgactgatggtttcaagccaaagtattttttgaaaatgagcgggggaaccgtggtcccaccgcttgaggcatccatttggtacaggaacccaacaccaaaggcaaacacaacactgccgacgatgatcgccagcaaccgatctgtgaccaggttgatttctggcgtcagccatagcagcaatggcaacatgaagctgccgaataaaatgcgttttaaggtgctgcgatccaagaagaaccaagctaaaagcagcatgagcaagttgacgcccatggtggtgatgccgacttgaatgccggcaacttcttgaaccaaaatggcaattccggttgcgccgccagctgcgacagcgtgaggtgcatagaacatgttaatactgattgcgatcagctccaacgctgccacgatccaaaaccatttgaatatcggatgacgcatcgttttctgcatcaagccaccctttctgttaatcatgtttaaaccgactcttatcgtactaataactatactggaaaagtggtggtgtgacaaacaggcgttatctggccttttcgtctattttgggtatgttctatcttacgtagaggtcgcgaaagtccgagctagctcagcagggattcggggtggcgaccgcgcagctagagtggtgggcaagacttcgagcccatcgccgcttcgccagctctcctgtttctatctttgtaatctgaacagcttgtctgttgcatggttatattcgatctttcaaaatttaacatatctaatcaaatcagacggcatattaaaaaatgcaaattcaaagtctccgaataagtaacagaaatactctctattcttcttcccgcaactcacccaatcgccgcttcaacacctcaacctcatcctgtagctcagtgccaatgtcagtttctgctaccgttcggcggcgggcttcggtttcgacgacgcggcgggttgaaatgatatcggtgaggttggcgatggcgtcggcttttgtggtgaatggttggtgcgtcactagttgcataccataagaattatccaaaagcgtgtaaccgccgatcccggtggttttttgatacggtttagaaaagccgccgtcgatgacgatcattttgttgtttgccataatggggtcggtgccttttttgactggcgtatgaccattaatgacatggccgaattcaggatcgaggacaaattccgccaagatctttttgataaattccgggtccttacgcaggtgataatacggattacggccttcgacatgggctttcggatcgctaatgaaatagcgttcaaaggtcgtcatgtcgtgcttgccaaaaagcggtgaatttggaccggtccagagataccacatcagatcggttgctaagtcagcattctccgttggttgactgtatgccaaccgaagatttgcttccagcatgtcaaatagttgacggccagtataagtagtccctttaatggtcaagccaataaaattgccatcctcgtccaccggcacacacccgtgcagcaacaaattccggttgtaccgcaaatacatgctgccgtgatcaagtagaaaatccatgtggcgatgcaacttttcggagtgcgtaaaggactcaaccagcgagtcaatgacctcttgctcctctggcaacaacttgtaaggatcagccaaatcaaccgtcgcaaaacagccgttttcaatcgtataagtatcaccattcaacttgatggttgagaaatcaggcgccagtttctccagcactagccgatgatccatgtcaaattcaggccgacgtttaatcactggtccttccagcttaaattgaatcatcgcaatcgcctgatgaatctgggtaatttgaagttgctccgcctcagtaattggtcgatctgatcgctccatttttggtgaaaaggcgggattatcttgatagtattgttccgctaaccgggccaaatgccgcaaattaatcccataaacatcttcgagaatacttaaattgttataccgcgcggaaatccgcaccaaattggcaatgcacaaagccgagcccgcggcgccgccgatccaaagaatatcatggttgccccattgaatatccactgaatgacgccgatcacgtctaatcaagctttcaaccacctgatccggcgccggtcctcgatcatagatatcgcctacaacgtgaaagtgatctaccgttaaacgttgaatcgtttgacacgttgccgcaatccactgatcggcctgttcaagaacgattaaattacgaataatttgccaataataagccagcttgtcaggcgtatcggcatcattgtacagcaactcttcggtgatatagacaaactccggtgccatcgccttgcgaactttcgaacgcgtgtatttggtcgcggtgaacgccagcaagcgaatcaaccggcgaaaagtcgtcaaataccactgttgcaagtcatcccccgccatctcccgatgaatcgccgccattcgctcagacggatagtacaccaaaaaagcgaagcgctgcagggtcgcctccgtcatttcatcgcgaaaacaggaacgaattttgcttttcacattcccgctaccgttccgcaaaacatgctgaaaggcgttatactccccgtggatatcgctcataaacgcttccgtcggcttaggcaaattcaaaatggcttccagattaatgatttcagtcgcaatcgctggcaccgtttgatacttcgccgtcagttcactgtacaagtccatgaaacagcttcctttcacatataccaattttggctcatggcaatatcatagcataatcctctagattgtatacggtttcagccaatttcatcatttccgcttgaaaaatgacctctgattcagctctgtcgtcactatcatgtcctaacattcatacaaaaaaagcccaaatgatccctagctaatagtcaatgatgaatgtccaacagtaaacagcgaccagttctcgctccaccatcatcccgcgattgtcaattgctcatcaaaaccaactcagtaacacccaaagcatacgcaccaaggtctcctcacccataactggggccaccatacgctaatcaccaatcgcatcaaaaagcacaaaaaaaccgtctaaccacagacggctttcattgaaacaactagcaaaactaacttaactgtgcgcgtttttaaacacttgaggtactgagcaacgccgcccacaacttctggcgccgaacttcgcgtggtaaaaatacccgcaccgagtcctgattaaacccaaataacagacgacgatcgtccacaatgatcggccggcgcaaaatcgctggatgctcggacaaaagggcgatcgcttccttcaacgacaacgcatcaaagtcaatatcaagggcctgaaacgcctttgaacgacgggaaactaaactatcaatgccatcttccgaacgagcgagcaattccaaaatctgcggcttgctaataccttgctttgaaagcgaaatctcttgaaacggtaatccattcgcttcaagccaagctctagcttcacgactcgactttgacgagcccgatgtatacaacttgatcatccaatcacctctcaacgaaacaacaattatttattattgtttctttgccaataccacccacacattagatgccaatcacattcacaagtcaaaaagatttactcacgacacgtttttattctctttataataacttaccatagccagatgatttttacaataatgttactcataattttgctcatagccatcagtgacagctaatcattgaaaagccatctaaatcatctttcaaaatgagaagcctctcctgaataaaagtagtaaagcccataaataacaattgcacgaacataaaaatcgtcatgatttcttgtgaattactagcacaatccttgatacattatttttgcatcagcggttagtacacaacaaacttagcacaagcttatatcgctttcaataacattttttcgaaaatttaatttcaaatactaacaattaaataaaatcgatgacaggaaaacagcaaattccttagaggctcatggcatttcgaattgattcaaaatcatcgactgccaaaattcacaaaaaaagctgtgcacaatttattttaaattttattatacgacttattgtagaccaaaaaaaaccgccaagtgcatgtgcacttggcggcagacgcgaacattacttcgcaccatcggctactttctttgatttaccagctgtcggttgcttctcgctaatcacaattgcgtcatcaaccagatcagcttgcaacttcttagcctttaaatgatccaaatagaagtcagtcaccttatcacggatgttgcgttcgatcacacgccgtaatggccgtgcacccattgcttcatcataaccttgttcaatcaaccaatccttggctgcggcggtaacggttaacgcgatccccttcttggtcagggtgttattaacgtcatcaagcattaagtcaacgatcttacccaaatctttcttggttagatgactgaactcaacgatcccgttaaaccggttcaggaattcaggacggaagtaaggtgccaaccgcttcatcagatcttcgtcttgctccttcttgccagtcagcgtctcgttgccaaagccagcattggaagtcgcgataatcactgtgttcttaaagtcaaccacgttaccttggccatccgtcaaccgaccatcgtccagcacctgaagtaacagagtcaaaacttgcggatcagccttttcgatttcatcaagtaaaacaatcgaatatggattgcgacgtacttgttcggtcaaggtgttgttgttgtcgttatagccaacatacccggcactggtaccgatcaacttggaaactgccgtgcgatcactgtattcagacatatccaagcgaatgatcgcatccttgctgccaaaaagatctaacgctaattgtttggccaattcagtcttgccgacaccggtaggcccgacaaagaggaaactgccaattggccgattgccttcatcaaagccggctcgattgcggcgaatggcgcgagcgaccatctcaacggcttcgtcctgaccaatgaccttgcccttaagacgcttaccaatacccttcagacgttcaatatcggaagcgccaagtttggaaactggcacaccagtcaagcgttcaaccgcagccgctacatcattaggcgttgcaacgacaggcttctcgtctttcgtaccatcaagctgatgttgcttgtcggcaatcgtcttcttaaggttagcggctttttcgaagtcctccgccttggctgcagcatccttttgagcgttcagatccttaatctgtttctcgagttcaaccttatcaacaatcggatgcttgcttgccaaatgcgccgccgtcatgtcaatcaaatcgatggctttatccggcaatgaccgctgtggtatatattggatactgtaatcaaccgcagccttcaaaacattttctggcaattgaacgtgatgatgctgttcataaagcttcttgatgccttccaaaatcttaacggtatcagccgcggtcggttcattaatggtgacatcgttgaaccgccgtgccaacgcgctgtccttcatgatcgtgttgcgatactcatcctgggtcgttgcgccaatcacggtaatctcaccgcgagatagcgccggcttaatgatatcggccaaccctttgccgccagactcttcgccgccagtcgcaccggcaccaagaatttgatggatttcatcaaagaacagaatcacgttgcctgccgctttgacttctttgatcagattctgaatcttctcttcaaaactgccacgatactgcgtgccggcttcgaggttcgacaaatcaatggaccaaatctgcttgtccttgatcgactcgggcacattgcctttgacaatcgcctgcgccaatccttcaacaaccgccgtcttgccgacaccggcatccccgaccaaaatcgggttattcttcgtccgacgactcaaaatttctgctgtttcttgaatttcatgctcacgaccgatcacaggatcaagcaaaccatctttagcttcctgcgttaaattacgcccaagcttttcaagaatgccaccttttttaaccgcttgttcaccagtcgtttcaactggaatttcgtcaccttgcttcggcaactgcccagttgctcgatactgtgcgaattcatctggcgtcatttcgtgaccatttaccacataacgggcagattcacctttgcccataccttgtaacatttgattaaaaacatcatccatatcatgattgaaaaacggatcgttaaagtttgccataacttcattcctccttgttgggaaagtgctcggaaaaggcgtggtgcggaggaagtgctgtgcagtttttctaaaacgcgcttaccagcccagaaacctgcgtgtaaggaccttggacgcaatggccaaagcccggccatcacgtccaagcccacttacactccagtttctgagcgggctggctcgcgctctgctctacagcaaaaagtactcccaggcgcactggcagtacttttgtgtcgaacttattcacttgttggcacgtttgccgttgcgccttttccttgtttacataaagtagtatagcatgattttagcactcatgcaacgagagtgctaaaatttttcaaaactattttcataggcaaacacccaagtcgtctaataccgtgacaaaagccgcttttcaactttatgctcattaaaacgcaccaacggatccccgttaacaagtgctcgggcattctcttcaaaaatgtgtgccttcttctcaccacgcttgcgagttaaccgcttgaaggcatcactcatttcgtagctccgacctggcaaatgatgggcgtcggacgcaaaaacatgtgccaaccctgcatcaatgatgtcttcagaaaattgctgcacctttttgccaaacgtgcctacataactgctggccgtcacttgggcaaacgcaccgcgttcaatcatctggtaaagcaaccccggatgcttcatcagacgagtattgcgctcaggatggacaatcacaggaatcatcccacgctgcatcacctcaaacaacatgttctgggtatacagcggcacatcatcagacggaaattcgatcaacacataatgacccgacgcgtcgcaagtcaaaatatccccatgatcaatcgcgtccaacaactggccattaatccgaacctcttggcatggataaatcgtcaacggaatgttgttgcgatccaactctccttgaaactcgtctgtcatacgaatcacatccgcagcgtgattcgtataccgtccattcatgtggtgcggggtcatcaacgcatgcgtgatcccgtccgcaaccgccgcttgtgctaaatctaatgaagtcatcaagtctttcgacccatcgtcaatgcccggtagcatatgacagtgtacatcaatcatctttcagttccccttccaatatgtactagtatctaatgaagcgctgacaaggtcaaatcgttttttgtaacagtttgttaacgatttgcaataaagccccatcagccgcgcgatattcccaactttgcggtataatattggaatattcggacactatggaggaaatgaggtttagaaatgaaaaagatcctagtacgcgttttactcgtgctactcgttgccgctcttgggtttggcggtttcgtgtattacatggtacataattccacgtcccagatttattcttataataagaagacgaataaatcgtcagacgataagactgctagcaaaaagtccgttgcttacttgttactcggtacagatactggggaactcggaagatcatataagggtcgcacagataccatgattgtcgtcgttgtcaatcctaaatccaaaacaacaacgatggtctctgtacctcgtgacaccaaagtcaatttcgacgacgtcacaatcaaaattaacgcagcatattcttatggttcttccgatacagccatggcagccgttgagaagctcctaaacatcaaactagatggttatctgctcgtaaacatgaaaggccttgaacagcttgttgatgccgttggcggcgttacggtaacatctccacttagtttcgactacgaaggcaagtcattcgtcaaaggtcaatcctatgacctctcaggcagtgatgcactgaagttttctcggatgcgttatgacgatccgcaaggtgactacggtcgtcagatgcgtcaacagcaaattcttacagctgttatcggcaaacttaagtccaatccgacaaccgttttaagccaaaagtttttagacgcagtcggtaagaacgttcgaactgatgtgtctctgggatcagttaagaacctagcaactgagtaccgcgatgctggcaacacaattaagagtgatcagttgcacgggacaggtcagaatattgatggtcaggattatgaagtcatgtctgactcggaaattacgcgcgtgcataatgtgttgcaaagtgcgcttgacgcaaagtaaaaaaagagctgtacaccgatgttgaaagatcaacacggatgtatagctcttttatttggctctgcgtcaactggtgttgaagaataaatttatcatttgaggcggttctccatttggggagccgtctttgtcatgttatgccgtgatttggtagattcgtttgaagaagttcagctgattcttgaagccaaaacaggatcgtttgagtgacttgatgaggcggttaaccccttcgatcggaccgttggaataagggctggtgacagcggcgagaacagcgactttgtgtcgcttaagcgtcgcgatcgtcatgtccattgccgtaccgtttggctcgtaagtagctaacaggtttgccagttccgcgggatgtttcttcaccatcaaagcatcatgaagcgctaagtaggtctcgtaggtttgcttgagcttgggctcagtatcaagtgcgatatcgatggcctcctgttgcgtgacgtattcattcaaaccaaacaggaactgtttgtgtttagcgtcaggcgcagtttgatgaaaaagccgccagtttgtcttcatgatcttataaggacggctgtgcttgtcatcaagctgtttgagcgcttggacgcgtacctgatcaagggcacgagccgcaagttgaatgatatggaaccgatcaatgacaacttgggccttggggaaaacctcatgaataatcgtctgataagctgcattcatgtccatggtgaccgtctggacccgagtgcgttcagcgagtgaataatgagcgatgaagaagtttttaatcgtgcggttgaatcggtcaccaagcaaggcaatcagatgatgtgaatcggcatcaagacagataaacgacatcatgccatgagtggaacggaactcatcaaagcagagtcgcgtgggtagccggcgagccggtcggagtttgagattttggtcaatgatccgttgaaccgaggaagctgagattccgataatacgggcgatggttttgactggcaaccgttcatgcgctaacttcatgattcgctctgtcatgtgagtggcgatcgtgtggttgggttgcacgagtggcgtcttggcactgactgtgtggtaacagttatgacagcgccatcgttgcttgtgcaagtcaatgactgtcggcatttcaaccccattgaggacgcgcacgtgggccgtgtaaaacccgttagggtgcaaggcctcaaagccacacagtgggcaccgggttaaccggtaagtcagctcggcatcaatcacatgatactggcggcgacgtaccccgttgccgcgatattcatgacgaacaaaggcaactttgatattatggtctggtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttctcaacaccagaaagcgtagacccttttatttttcatagtttggtttctcgaaaattttagatttgccaaagcactgatctaggtgcgcataaattgattcaaatctttttactcaattaataagtatgccattaaaaattctatcgaaagcggccactagtaggctcctgttgggtgaatcacaacaagaaccgtcttaaataaaatcttgagatcctcggaaatacatgcattgttaatataatgaatgtccaatgcaaccatttctgcaaagcctagatcattacgaccggagatctgccacaagcccgtgacacctggcacaactgtcagacgttgccgatcatagtctgtatattttacaacttctcgtggtaaaggaggtctcggtccaacaagactcatatcaccacgtaatacattatacagttgcggcaattcatcaagactatatttgcggataacacgccccacacgtgttatccgaggatcgtctttgattttaaacatagcaccttcaacgtcatttttcttaagtaacttgtcaaccattttatccgcaccggcgaccatggatctgaacttccacatttgaaaatgtctaccatctttacctaaacgagtttgcgaataaaacactttcccgtgcggatcatctaacttgatcaacacagcaagaactaaaaaaaacccactgagaagaatcaaaccaatcaaacttgctgtaaaatcaaaacagcgcttcgtaattagtggctgttgaactaggccgccatatcttcgacccttgtagtaaatttatagcgaatttgataggcctcaccctcgaatttagccaaaattaaaattggtatagcaaatacccttaacagggtcagcacattgctcaagacgatggccgcgtcaatcttgacggccagtgattcagctgtccgagtgttcaccaagtcaagccccagcgtgcccttcataaaagcaaaccggcgttcaatggtacctcttcgattctcggcatcagtatcctcacgccgtttcgctgcatcaacgtgttttggatgccggccaagcttcggaccgcagattcggatacccaaatccttacacagctttaggttctcccgattacggtacagcgtatcggccagtacttcatccggataatgtccatgaaggtcgtaatagtggtctaaagtttccgcgaagtcttggccctcagagaatgcggtgaaatcaaaacgttcaatgtcgactacgccttcacttaacgaacagtcaatcttcgccccaaattcaactttagcattggccttaccacgttgaattgggcgaatgtacggctgttggagactaacaattcggtcttcaacgtggtgagtcttgtgggtatacatgtaccattgctggtcaaatagaattcgaatcacgcctaagcgaatcgcttgttcatctggtagagtcgcaccctgatcgatgaattcgttgatgtaccgcaaatcacggcgcacatattgaagttgggccttgacctgtttatgaaagccaccacgctgttgctttggatgtcgtgaaaatgaggtccaacaatgcttcgcctcgcgtttgtacatgcgtgggtttggcacaccaagttggtgtgccatatcgatcgccatcgcctcaagattcagccttgcttggttgaggaggacggtgtcttgaggatacttgattttgactggcactgcggttgcgtccgtgatgacggtgtccactttgaatgggaccaacgcttcgatcttggcgcgtactgtatcattcatgatattcgtaatcagctcggagatatcggcaattcgtttgcgaaagtgtgccaggctggaataattgaacggctcaaccgctttgtattcggacaacccgatgaaatattgaagtgcgggtgtatcacgaattgccgcaaccaccccacgatcagttaaacccatccgttgttggatcaggattgccccatagagtaaacgaaatggttttgccgcacgtcccgcatttttggtgaactccaattggtatgcctcatcgagagctttccagggcatgacctccgccaactggatccactcattgttagagctaagtggggtacttaaaccggcaccaaaggattcaaatgacaattgaagcgggctgtgacgatagaccatacgataacctccgagtaggttcccaaaaaatgcaaggaaaatgcaggaaaacagctaattccaatggatttattataccgcaataatgcatatattagcttaactgcctgaattatagaatttttaagcagccactaattaagtacgttggcgtcaatgcaccaagatcaacctgctcagcctgagcctgtctatggttagatgctgtctccaaatcttacccctccaatattctaaagtcctaaggtaatagtttccccaaattacctgcttcaagcaatcttataacattcctaatgtgtgttcaacctaaatttgttacaaagcagagaatcgttatccaacaaagctaattgacgagattcaatcaaattgaggtaatatgtatttaaaacactacaaggcgcctttgttcttgatctagacactctttatgccaacctctatcaaacattaaaggtaacctcaaagttcagtttttaaccagtaacatcaaaaactttttcaaatgaggctgacctatttttaatgaaaaagtatgacattcaatactgttatacgagcgtcagcccttcagtcaatagaaaccattctcgatacaaagggcactttttttaagccagatgtaataagatctgatactataaaaacaattaaaatgattatcggcacgaaattcggctcaaaattcggcaacactcgtaacacaatcttaagaatcacaacatgaataatgaaaatccccatcgtgtttgctgcgaaatgatggactaagcgacttaccaagtcactccgtcccaaagtaatcacccgactgtactgtaacatcaaaagaagaactgctaacatgacaaacaatgagtcgtagtcatattccgcataaccgtttcttaacaatactgagcttacaagtgcccctatctgaacaacaagtactataaatacaaatatgcaaaatcggatgttttttgacaagtcactggcatgttgagttctgcgcaaccaagctcccatcatgaaatagaaaaaccaagtccacaatctaaacgtttggataaatgactttgccaccggatatctcatgtagtaactagaaaacatgaccactaaacagacgacaccaaaagctaagagtagaacccggaaagcagtccaatgatcgcgtaacagccgatttaaaatcggagccattaattggacaattattaaggctccaataaaccaaaactgagaaaaaagacccttctgaaccaaaaaaccggcaccaatttgcactggattaagaaattctcttctggtaacgagtttaactataaactcaaaaatcgcccacaatattaccggtgtcaataatagactgacttttcttaatatatacggataagtgacattctccttgccaaggatcaagaaaccattgacacaaaagaacagaggaatcgagagagtgcctacgtaatagtagaatcggattggttgaaaaagtaatctcatggttgggctttgcgatgccacattaaaatacgatcccgcaacatgtaaacaaactaccccgaaaatcgcgaaaaatttcaagaaatcgattccttcaaaacgaatcttttttgtcataatgctcccccaaaaaatatctaaacaaagattttgaactggactcgaaaatcctgcacgaagtcaccaataaatattcaagcaaaaatcaaacaatcttactacagatcgttatttctagctaagttcacaaatgccattagacttcaataaatacataataaagcatttattttgtcttccagtactccaaaaaaggagcattgtcttctttgcatgccccgtgtccaaactatcttgcaaccattaagacgttctccactttaacatatttatctatatctcagaggaacttgcaactacacgtttataaagaaatcagtcacgaatctcttctcctttttttatcttcagataccatcgccaaacttttgcgtacagaggatagctaacccaaattagcataattgcagctttatctcgcgcgggcgctttatggtcacttaagattggcttacgtagttctttgacatttgcaataatttgagatcgaatgttttgatgatctgttacaccgttcatttgattcaaggtactgatataagcgtataacattctgcgtttacatggttgatgaagatcaggatatactttttcaacttcttcagtcatcaatctcgtcatgaaaatcaagtctaattttttcagcgaaaacgttttatttacaattgaatcatctctgaataagtagttgtactttgcatctgacccaacagcaatcgtgtttgctgctaagaaagtcttgtaggtggttgcgatatcttcaaataagcgaccttttggaaaagagatgtttttaaaaaattgaataggataaagttttgcccaagcggacgtatcaatctggtcatcgtacaacattctctcaatcgcagtatgtgaatctattgacggactgcccttgtatgaattcacttggatcttaccactactgtaaacagtgcgatgcgaacaaatggccattgttgcattattatttatcaaaatggtgtaaaggtactcaatataatcagtatcaacgtaatcatctgaatcaacaaatgaaacccatgtacctcttgctacagaaataccgaaattacgtgcatcagaaagaccgccattctcttttgaaaaaactcgaatgcgcgtatccttttcagcattcatctgacaaatcgccaatgaatggtcagttgatccgtcatcaaccaatattatttctatattattaaatgtttgagcaagcaagctgtctaagcatcgctgcaagtaattctcaacattatatacggggacaattatagatataagcggcttatttttcatagactttcccaccaccttctctttatgttaatttaatacttagagcgcttcaaaaaagattctcatgtgaattcttaagaagtgtcatttgcacggttgtctattttatctacaagcataatcgaaagatgatgccatattaggcagtttattagttctttgttcaatattatatctttggtagtagtttcaaccagtttcgtgttttcttagaagctatgctatgtttgaattcttaaacctcaaacctagacttgcttggaaacttatgctctagtgtatcaataatgctgtcagccacctgtgcttcatcctcagacgcttgcgtatcattgatacacagtactgaatggatggacttttcaatgtccctgcaaatctcctgatgcatcgtctgttcataatactgaccaaagtgttttgatcttggctggaattcattactttgtatctgccaatatctaaatacccaatctgttaggtctgaaggatctctaaaccgatgtgcactggtttcgcttagtttctccccttcaagtgaccatactttttcaaaggttttttttagatacggctgtggcgtatgtgggttaaagaaacctggaatagcatgccatggtaacgtcaggaatgaacgaacaagagcctttccatacttaaaattgaacactttaaaaggagcttgttttatcaaactagttttcgagaaatacttattgatcatcattgtattgttcagcagaaggtggctaaaagggtcgtcggctggaattactgaatatatagccaaatctctcacaatatccggatttacgaaaaagtcttctggttttactggtttattaatgagcatatcgtcattaaataaaataaactgatcgctcaaaccacttattcgatgcaagtttaacaatatcgggttagaactaaatgttggcaaccatttttctggaatataatctttgtgacgaattttaactaatttgtcgttagaataatccaaccattctggccattgatcattagtaactaagaaaatcttgttcacccaaggcgcaaaatgatcaatagaacgaaataaatatttcaacaagccactatctcggtacctatactgtccattcaactgtgtccttgatgcgaagcctttcccctttttttcttgaaataattgcctttccctttggagagttgggtctgccccgtccacccaaggaataacgatatcaattttcatattgcccctccaaatatcgaacgttactataagtattcaacccatgttcatagacgcttgtgcgtaaaaaagaagaaggaagttttaatccagcgaaactttaatataagattatctaggagcattggccaacacaaatatataatgattgccataagcaaaaccgtttcttcacaattagaaatagcttcaaaaaataattgaagtctatttaatcgtcttccaaaagcccactgtacaagacagaaagcacactatatatcggtaaacttagaagaaagcgtcccaaatcacttatttgctcaaaggtgatattgttcaatgctggggtgaaaaacgattccagcgaagaagccgtgtaacaatattcttattttctttaatcgatcagacccgtgagccgagaccaacactaccttctttacaaagccgtacataaatctaagtgtttctttaagtcccatttttcttgaaatgtaaaagttattacgaacatcgtaaaaatatctgggaagacgatctttactatcagtgatgatatcgactttttggtttgtacccattttgtgtgtgacaaaactatcagtgacacagaaactgtcatattcatcggaaattcttttcgaatactctgcatcgtcaccccaaatgaaaaagtccgctattggataaccaaccttcttcacaacattagcattgatgaacattgatacgaaagagctatgttgaattttaaccaaatttgaagaacggctttcattccaaaactttgataacttaggaatattcattaaagcagcactaccatctgtccagcgaacattactggccagaatcccccactcaatgccatctaactctaaatctcttctggcgtccattaacggaactatcgtttgctcacttacaatacaatcgttatccatcacccaaattgtatctgctcctaaaaacatcgctcttttcatgccgtgattaaacccagttgcgccacctaaatttgtcttctcgttcaccacatccagcatcggctgctcttcagttagtttttcaagatagacacgggtatcgtccgtactcgcattatttaccacaactattttataaagatatttatgacagagtattaactgatgcaagcactcctttagtagatcaagtttgttgtatgttacaaccacggcaatacatctcgaatcgcttcggctcatattactacccctttattaactgtttattaaactaattctcaaagtctaaatacttttaattactgaatcgaattgatcatttcttaaagctacagatccaagtaaaatgatgaagatattataacttgcaaacaaaaaccaaggatcgccaaaggactccagagccaaacatattaaaagtaaatccaaataaaagtcgtgtgatttagcaatacgtttcgaaatgtacatccaaactaaaatgaatagtaaacttgaaacaattccgtattttataacgtaacgcattagactactatctagcgtttgataaggactcccgaaccaatcaaaatctgtgacctcataaattgggtgtccaaataaagtaagaccgtattgatctaaataggttctccctaaactcagccgatttgaaagcaaactgttaatttttgggaagtcgtttgcattatagcttagatataaaattaataaagtaagcatagggacaataacgattgagagtatgtacaatgttctggaattaatatagtgtattttaaattttgctgctgtgaaccacgttatcaggcaaaaaatagttatgataaaaggtgcctttgtttgagtctgagagtaagcccatatattaagacaaaatagaccagcaaataaccagaagccaattttttctcttttagcccacagtagaaggagagttataaacagaacagtgtgtgctaaaaatgaaacccagttataacctaaataaaatcttaatcggctttgggaaacctcaatcttatttggaattatagaaagagttgcaagagctattaatactgcgttaattaacaatcgataatttgccaaaaaggaaaatattctgttgtagtgaactccgattgacccaatagaaagaattgcaatatcaatccagttggcatctccagctaacatcccattgttgaccattaaaaaaactaaaagaatactcgttattagaaatctgataccatcaatatgaagaaagtctcgaagaaaaaaagaaataataactaagcctacacccacagcacgaaaagctaaaggccagaattccgatacataatttgaaatttcagaaaattttataaactcattaagagaccagatcgcgaccccaacaaaaaataccaaatcagatgcgttaactgtgcttacatcgcttttggttttaagttcagtattctgaaaactcatgttatcttcttcactggaaactgtttgcatcttcatttatctatccttttcgttgatcattaacaacggatgctgtgctatcttacgtcttcccgatgctttattttatatgcgtgttgaattgtcgcttctggccggtaaacttgttcatcaaaaagatgagtattttttttggccaatgattggactccttaaattgcacggggcattcgacaacttgcttgtcattggcaataacccacacgtccataagaatctcggcaataaaacccaaagctcgcttctcattgccgataagtttatcaaagtctaaatttttttcaatagtacgtaatgttggaaatagccatgaacaatattgattaaaagtttcacgtttcataatgaacatattaaacatatgagcggaagtgctgtccaaaacggtttgcagagcgcgttgatatgattcaggaaatgaagaaaacaccttttttaaagcctttagctcttcggcatcatggctatgtatatagtggctttcaatcgtctcaatgtagtacttacgtttcaacggcagtactacatctcctttcgcaagcaaattcagaatctgttgttcattgaggaggttactaaagtcttttctaaaggatttctttgagacaaaatatctgcgatagtgattcaatccgacgatgctcgcgtcagaattcttccatgcccaataggttgctgttaattcgttaaaatgtggattttctaaagaaatattatccccagtcgcatctgactgaaaattctttggaatattcttgtgaaaggctgatccaacaaaaattggaagataaatcttattatcagttggcatttcatattgcttatgactagctattaacatttcaattttcatttgcaaccctcattcgtaataaaccctattattttatctcgatcaagatctcactgttgtatcgctgcaagaacttggaaggaacactttgaactttgtcgccgttttctatctcgttcacatatttatagttcagaggaactttttcgtcagcatgcataagcatccaggaatactcaagatcaaggtgcccaatatcaagaacctgaaccgaggtttcgaaatttacatcatttgctaaaaccgttgccgttggtccaagagacacaagcaccagtatgtctgaatcgtcaatgttcttaattaaatcagtaatagtttttgaaatctgggtatagtgttcaaatgcgttcttcgctggacaaataattctttcaaccttagctgcattattaagaaggtcattaccaactccaaatctagtttcggatccttctacaagaatcacatgacgcttatcccaaatttgcttgattagtttaaacagacggtcaccttgagacctatccttataaatcatgtatggccttgtaaccaaggaatctaagtaagttcttttggagcttaatgtgcgcacccaccgatatccatggtggcctaactgtccagcccagaaaaaggcatctaaccgcctatactgcgttaaaccatcaaaagcatctggaatacagacctggaatcccgggcggctggtcttgaccacttttaataatgccgaggctaattcggatgagtttttttcaaagttatctggctctcgatctttgaacatccatttgaactctccgtccccaaacctagcgactgataaacgttctttaaggatgatctgtatcgacttctcaatcggtactactctaatttgcttccgcgagattactaggtacatgcgaaaaacagcatacgcaattagttttgcaaatccgatggcgtttattcgaatatctctgctaaatcgctgcttaatcttcaatctttttccccatggtctcttcattcggaaaaccaacggcaggattaaagaaaaagccgttccatgttcccgagaaagccgctcctagacgagttagtcgatgatctttggccgcaagcgaacccaaccctgtcaccatattcgcaagaatcattttaacaatgtccttcttactcccatagtgacgcttgatatagatcaaattgcgatacattgacttgaaacgccaaatacgatctgcctggattgtctttaggctatcctgcatcaagttgtagcttgttttgtgaacagcgatactgtcacttacaaagaaactcgctttaaaggatgacaatcttgtcgtatattcggtatcatcaccccaaatctgcatctgacccaacggaaggcctaaattcttaacgttttcttttggtacaaggatggagacgaacgtggccgaaacaaccccaacaagtccctccattatcttatctggccaattttttgatacatgagcaatgtttgttgcagagccatcagtccatctcacatttgaacatagaaatccaaattcactgtttagcaattttgctttttttattaatgcagaagaagcttctatatttggaatagtgtcatcatccattatccaaatataatctccattcccttctgcggtagcctgattcactccatattcaaaaccagccgctcctccaatgttatcgctaagtgttgttgctttaacaagggaatcatcaatctttgtaagatattcggtggttccgtcagtgctatgattatcaattacaaaaattccagacaagttctcgcgctgactgagtaaagagtccaagcattcttttagtaaaggcaacctattgtaggttaccacaattgcatctattattttctccatcattttccccacatgttgatcgcttaaacaattaatctattcctgaagtcttctcttgaaaaattcaactgaattggccgtgaactttctcgcaaaaagatattttggattctctattaaagaaacatcgtcaacagttagatatcgtggtgtcaaattgtgcttagatttccaaataaaatccacatagcgtaaattctcagataaggtattcataaatcgtgtattagcaatcagactctggataaatagctcatcacagcaataagtataattaaagtgtttggtaatccaaccctcatggttcaaaatatactgtgccaaatcatccgtaatgctaaaccactgagaaccagactgaactgtaattttccgtgctctattaatgccaatatatcgctgcacatagcacgaaaaaaaatcaacatatttgaagacgttccgttttttcccaatgaaacggtcctgaagaaaatggtattgctgatatctcaaccgatatctatcaggattttgattcttaaggcggtcactcacctctaaaaaatttttgccttcattctgagtaaaaaactcatctattcgttgattcgttttgacaggaaaatcctgacctgataacaagtgatagtaagcatattcatgttttgtagaggctgttctcaataatctcaactcaatttggaccaatgaaaaacctccccatgtgccgttcatcctgtcgatgaaaacaacacttgagaagttaactactttttctattctttgctcgtcaattaagccagccttcaaatcaatatgaatgaaaaaatcatgttgtcggctgtccagttgatggatgatctccaataatgtctcatcaatcttaccagccatgattaaaaatgcatgcctcacggttctttcgccctctctacttttcccagtattcggcttgacaacctaacaaaattagatggttaattaaactctagcaggtaaagtacacctcatttatagttgagtgattcgaactaaattacttcttcacataaacttatctatctcgaagaatcgtaggcgttaatacccccctgagaattttaccatgtttttgtccattcgcattagtaataatttaaatgggttattaccgatgtacctttctaaaagacgacagcatttctagcaagactgtaggacggagcattagcaaagcaattacgtatattaatgcaccatacatagtagcccctaataaagcaacaagacttgacagcgataagactgaaataaaaattcgcacgcttatgcccataatgagtgcagctaggaaatacttccacacttcttggaaaatatgtcggagacggagttgatctttcactttaaataattggtatgccgtcaccaatagttccgataaaacggtcgccaccatggctccattgcttctccaaagaaggataaaaggcacattcagaaccatattagcaactgcacctagcacgacagacgttgtaaacggcgcgagttgattagtgggaagtaagtattgaactccaatcgcattactaattccaatgaagacaataacaatagattcaataacgagcaggtttgaaacaggatcaaaaccattaccgaaaaatatccgtgtaaatattggagcaatacccgctaggccagcagtcattggaaatgcgatgacgagaataaagtgcatcgatttattcaacgaatcttcaacttcatcatgtctaccttgtgcaaaactatgggcggtgtgtggaagcaaaacggtgccagtggctgtcacaactgcaagtaatatcttgacgattttgtcagaattatcgtagaatcctgatgcttgaacaccgacaagtgccccaagcatagttttgttaacttgtaaataaacttgagttgcaatctgcgggacaaacatttcaatagtcggtcgcaaatgattgattatttttaagtcggaccaacgtggaaatactacgtaacgctttaagtagggcaccaacgttaggttgcctaaaaactgcgatccagtgaggattaagatgtatagccaaagatcatttttcgtccgaacaagtacaaagatcaaaattaacgaaatgattttaaccagtgtatttcttaaaacggtgatgcgaaattcctcaagcccctgaaaaaaccaagaaacgtcaattgcagttgcaacaagtaagagcccttgaatgaggtaaaaagtttgatactgtccagacaacaggataaaccctaaatagagcaaagttgcaatccctgtagtcacaagtctgagaaatgttagctcccaaaataaattggaaagttgtttcgacttatcgcgctggtatgctacttcgcgattaccatacattgttagtcccaatgttcctaatagaacaaagtactggacaattgaattcgtaaaggcgttaatgccgattcctgtcggcccaagaacgcgagaaacgtacggaattgtgacaatcggtagcagaaggacaaaaacttgatagcccatattccaaaggagatttttgactactttcgtgacgattcacctcatttcaacggaatatcgcagtcaaatgaaaagctaagtcgtcaatcacttgctctcagtatcaaaaaactccccttgcaggaattgtaacgccgcagtgataacctgatccatattgtaataacgatacaagcctagacgaccaccgaaagccactcgaggagtctctcgagttgctaactcccgatattgtgtaaacagatgattgttctcagagttgttcactgggtaataaggttcatcgcctttagtccaagtagccggatattcgtgagtaatgacagttttaccgcgattgcctttgccaaattcgaaatgtttatgctcgataattcgagtaaacggtgtttcagaatcagtgtaattcaccactgcattaccttgaaaattatccgtatctaatacttctgtatcaaatctcaaacttctgtactccaaagttcccagctgataatcaaagaactgatcaatcatgcctgtgtaaatcaccttgtcgtaacgatttaagtagtcctgcttgttctccagaaaatcagtgttaagcttcacggtaatgttaggaacatctaacatcttttcaacaatctgagtatagccaccaactgggattccttgataaaggtcattgaaataattgttgtcataagtaaatcgaactggtaaccggcgaataataaatgccggaagttccttcggttctctgccccattgcttagccgtgtagtccttaatcaacttactataaatatccgtacctaccaaagagattgcctgttcttcaagattttcaggctttttgccagccattgctgcccgttgttcatcaatttttgcctctgcttctttaggcgtaatgactccccacatcttattaaacgtgttcatgttgaatggtagattataaatttcacctttatagtttgcgataacttcattcgtatagcgattgaatgtcgcgaattggttgatgtactcccagactttttgattacttgtatggaaaatatgtgcaccataccgttgaacttgaatgccctcaatgtcttccgtgtagatattaccggccaagtgatctcgcttttcaatcacatcaaccaaatcgccttttaatgcccgttctcgagccaccgttgccccaaataaacctgccccaacaactagtaatttcatcgataaatcccccaaaatattcttgtctttgatactaaactacagagttcttttaaaaccaacctacttttgactttggtagccataaccatatccatagccataaccgtagcccctatcaccatgtttagctttaacacgctctactgatccaagaatcttagcctttgccagtttcaagacttcaactgtgcgccgcaagtctccctttaatgttttaccaatgttggcgacaacgataaccccatctgtcttcggaaccaacacctgcacatctgaaacagccaaaactggtggtgcatctagaacaatgatgtcaaaattttgtcgagcccagtccaataaatcgcccattcgcttagaatttaacagttcagaagggttgggtgggactggaccagaggaaataatgcttaaattattgacaaatgtctcttcaacgacctcatcgggttttgtttttcccgttaacaccgtcgtcaccccatcaagattaagctttctgaaagtggcgtgaaccgttggccgacgcagatcagcatcaataagtagaacttttttaccagcctgtgcccatgtcacggcaacgtttgcggagaccgtcgatttaccttcagacattgctgaagaagtaaacataacaacttggcatttatctaaagcggcgcctgcaaactcaatattcgtccgtacagttcgaaactgttcagaaacaacatgctttggttcagcaaaagcaacgagcataacaccatttttttgtgtttcttgatcttcctgatgacggttaaaaagcgttttgaatgaaaatttcactttgacttcctcctttagatccgacgacgacttctctgagggaagtctgggacaccgatatcttccgtcgcctcaccatcatctgtaggttttgttgcctctattgcttgatccatgtctcgcatgcgctgcacatagttcacaacacccaaattaactaatcccagatcatcagtaatgaagtcaagatccttaattgtttggtctgtaagctcccgaattaatccccagataaaggcagtcaaaacccccaaaaacagaccagccagagccatcattcttaaacgtggagataccggtgttgagcttgctgtcgcttttgaaactactgaaacgttcgaaatactcatcattttagcaatcttagtctcaaatacttttgcaacctcgttcgcaacatcacgcgcgcgaactggatcagtatctctgacgttcacagtaaacacttgagaattctgcaacgttgacacggaaaccatcttagcaagatcatcctcagaaatatttgagtacttagctggcttcaacttatattgtgctggttgtgcttcttctgtcacatattgctcacgcacaccagtcgtcgcattatatctagttccatagacagctttttttgccttcttagtaagaactcgttgcggacttgttaactcatccgcgaccgtctgtaaaacaacaggacgcgtgatgatatccttgtatgtattgatgatctgaatgtcggcgttttgagcattcaactgcatatttggatcattctgttgtttccggttaactaacaatgacgtatcagactcgtattttggcgcaatcaaagccttggcaccaaaataagcagccgccatcccaagaattccaagaataatcattgcaacaaagctgcgtttaaatacattccacaactgcgaaaggtcgatttgcttgttcattaactctttccccacctaatcccgtaatttatatccaacaatcaaaatgcggaccacaagcagcgcagcccgcatttctaaaaaagactttttaaaaccctactccaaagcataataccctagcatgtgtgatcaagtctagctattttggctgactatcatgtttttggtctcaataatagtctgtcctgaatccgctctactccccttttaactaaggttgtttcccataaaattgaatttgttacagtctctttacaatttcttccaaatcggatctctagcttagtgtaaaagcgatacagcttattgagctaaatattgcagtctcgacaatgaacccacagtacattatcgcagtatctgtagacgaccaacaaacacctcagagaatcacacagaatatctaaactcaaaatattaaatttgaacccttcgttattaactatacgaagggtatgtacaaatgatgaacagtagtattatctctaaactaatttgactttcaacagccgccaccaatcctgatgtccaatataccaagcaatagtgtccactagtccggtctcaaaagcacactctggcatccagccgagcttctgtttgattttcgttggatcaattgcatatcgccgatcatgtccaagacgatccttaacataagtaatctgagactccggcaacccaagctgctggacaataagttgaacgatggcgttgttgttgtattcattatgggcgccaatgttgtatatttcaccggccttaccttcacgaagaactaaatcaacccctctgcagttatcacgtacatacaaccaatcacggatgtttttgccatcaccataaattggcaactttttcccatccagtccacgtgtaatcatcaatggaatcagcttctcaggaaactgatatggtccatagttgttcgtgcttctcgtaatattgacatgtgtaccataggtttcaaaataggaacgaacaagcatatcagctgatgccttacttgccgcatagggtgagtttggttgcaaaggcgaatcttccgtgaagtacccagtcgatcctaacgaaccataaacctcatctgttgagatctgtaagagcttaatatcgtgtcggtaagcctcatgcagtaaagcaagtgtcccttgcacatttgtttcgacaaagatttccggatgtaggatgctgcggtccacatgagactccgcagcgaaattcacaatggcgtctatatgatactgttcaatcaaataagccactaattctcgattattaatgtttccttgaacgaagatatgacttgggtcatgttttaggtcagttaggttattcttgttgcccgcatatgtcagcagatcaagattcacaattaaatctgcaggatgcatttgacgctgatagtgaacgaagttgctgccaataaacccagctccaccagtgattaacaagttcaaagtttaatctacctcctttattgcgagatgtatttcaagttcatcggcgctgaatcttcttcacagaatctcaaaaacataaatagcttttctcgtctatcgactgttgatcacagagatttaccgttggaagccaatggtcagcatcaatcataatatacgatgcttaggcatatagtacctagaaaacctattttaacaaaaataaaagcctattttaggcctatgccacttcaatatgacagtctctttacaattccgcaaaaacccgtcagaatgaccctaacttgtaaccagactaacctgatttttagtttaaaatataagcaatgcaatttttgggggttcactaaatcatgaaaaaaaacaagctacgtcttcgtgactggctattgagtatcgcgttgggattggcaattgctggtgtcgcggggtttttctacgtcaagcattatcagtctgagcaggcgattgcggttaaccaatcgacgcgtcagcgcattcagaaggattctaaggcgaaggtgaagaaggaaaaggtgctgaatcagtatcggctttatggcttaactgacagcgagattaatgcggccaaaactttgccggtgtcggcgattggcgattcgattatgctggggagttcggcatatttgaaggtgctttttccggagatgtcgattgatgctgaggtcggccggcaggtgcaggcagcacctgcgattattagtcagctgaaggcaagtggtaagttggctaacacggttgtgatcagtttgggaacgaacggaccgatgacagaggccgacattaacgggattctggatcagcttgggactgagcgccaggtcttctgggtgaccgcgtatgctcccggaaaggcgtggattgatccggttaacaagttgattcatgcagcagcgaaaacccatgccaatctgcatgtggtggattggtattatctggctggtggcaatgacgactggtttgctgatgacggtgtccatccgaacgatgctggccggccgcattactacacgttgattgctaaggatgtcatgcagacattaaaaaagtaacaacgaaaaaacctcattacctaggatcagcatcttgctaaaaaaagattcagggtgtatcccttccatttaaaaagacatcgagaccattgcctcgatgtctttttgtatttaaccaatgtttgaccaaaaccaggtgcattggaaacctaacccctgcgacaacttttgaccacagcaatcaaacctgcctgcccttctgccagatcgaaaagcttcagcgaaacctttcctgccagtaagctttttttctatagaagccactttcaatagccttatcgcttacttatccaaatccacaaaccgtgtcaaaatcatcatcacaacgccaccgacggccatcgagatggcttcgccaagcgcgatggtagcataggttggccagaatgggactttcgtgaggatggtcagttcgccggcaatggtgaacatggataaggcgaaaaggatgcccatgatggtgaatttagcccattttggctggacgagtttggctaaccagcggctgatgatgatgaagacgagcgtgccgagggtgccgattgggacatcgaggagtgcggttggcgaggttaaattggccaaaaaaacacccagcgtgacggcccagacataacggcggttgaagagtgccgtatagttgagcatctcggagaaccgaacttgtacgaccccgaagctgagtggactgagcatgagggtcatcacgacgtaaatggacgtgatcatggcggttttggcgagactgacgattgaacgatgggtggttgaagttgtttgcatgtttgttctcctttgtggctatgccagtagtaacgacgatcaaaggaaagtaagtatcgtcgtggaaggattgccttccgttttcagttttggtgtttcaatgcattaagtttacttttcgagccaaccgccgtcaatgggaatcacggttccatgaatataatcagcagcatcgctggccagaaataaggataattgcgcgacttcctcgggcttggcccagcgtttggctggggtttcttgagcaacccacgcagccattttcccgtcgccggcaaaatcagcggcgttcatgggcgtgttgatagcgcctggtgcgagcgcgttggcgcgaatgcctttggcggcgtaatcaaggtctaattgcttggtgaggccgatgacggcgtgcttagcggcggtatacgccacgccgccaccaccaccgactaaaccagcgatggaactcatattgatgaaaacgccgtgtccgcgagccagcatccccggcagcagcgccttgatcattaagaactgactggtgagatcaacatcgagaatgtgttgccatgccgagagcgccgtatcggtcacagtttgataaccatccaacacgcccgccgtattgcagacaatatctggctggtattgagccgcaatcgctgctgccgtggcaggatcgctcacatcggcctgaatggcgtctgtgaggttgctaattggttggaggtcaattcctaccacagtggcaccagctgcctgaaaagccgccgcctgcgccgcaccgatgccagaagccgcgccggtgatgatgacggtcttgtcggtgaagtcgaaatgcgtcatgcgttcacaagctgccaatcttcagccaaaatgtcacagtcagtcggtgaccagagactgaaagcttcgtcggcagttttgatcaaaaaatacggattcaaagtgtcgccttcgaatttgccttccggaactagttgcacatacaactcagtaccttcccagccggtgcgaacggccttcttgccggctttaagggacggtaaaattgcttcaaatgtcatgtcgatcattctccttcttttgaaatgcgttctccagatggcggtcggttattgtgaagaaagcctgttagccgaaccaatacttgatcaactatccagtgccactttgtcaaaccaagctaaccgtgccagttcgcgctcattgtctaaaatcagtgcatttagtatacgcgttttaccagctgactgacaacgggttgcgccatccttttaaggtcattctgacatttttgatatcaaaaaagaacagcctcaagtgacagactgttctaaaaaggtggtacttacaggttaatcacctgcatgagtacctcggaaacacgcgcccgttctttctctggtaagtgggttaagtatttcaccaccgctaatgtgctaatatcgctcatttccggagcaataaagaagtcgcctacctgcatatttaaagcccgcgcaatgtcggtcaatttttttatgctgatattgttgacgtctccacgctccattcgcgaaatcagactgatcgagacgccggatcgctccgccaacttctcaatcgtcaagttcaaactgcggcgctgttggtgcaccaatttcccgatattgtctaacatggtttcccccacctttaatgtgcggcgttatgctttaacattagatgaaacgccgggctatcaaaagattttataatattatttaataatctaaagatggcctattctcacagaacataaccgcactgatcccccacatcaactcaccaattcttgctctataactattgtaaacgctcgcaatgaggaactgccaaaaatcagcttaattaattaaaaaatacacaataaaaaaacaatgccaatttattcagcattgttatttactttccgcggttgctggcacaaaggcccataagctgccacgtgtgaactgttcgccatccgaggtatccaattcactgatactattattcggcggaatgcgcatcgcatcacgcgcagaatcgagatcggcaccgaggtatgtgcttaataacagcatgccgattaaaccgtgcgccacaacgagcactttgccgtctggatgggcatcataaatccgattgattgcccgccgtccacgttttaacgcatgggcaaatgattctgcaccgatacgctggttatcaaacgccgtcaagttatgataataatgattgatctcaggatcatcttgcactgaggcgagcggctgaccatcccatttgcctaaatctacctcgcgcaaatcacgatccgtcacaatcggcggttgaacgactcggctttgggccacaattaattcagccgttgtttgcgcccgcggcatcggactggcatagatgcccgcaaaaccagtcgtcgccaaaaagcgtccaactgcgatcgcaccttcgcggccactcgctgtcaacggcgtatcggttcgtccaccgttaaatcgccgcgccaaattcgtttccgtctgtccatgccgcacaaagtaaaacttggtcatctcctgcacgctccttataaacacgttcatcaggccagcaaccggtccgacgcacgttctgtctttgaccatagtgtagcagaagcgcaccaaattagcggcaataatcagaaaagttcagcccgacttaaccaaaactgcaacgattatgcctattacgtcagcattttggcgacatcaacgacaagaatgtgctcaccgcctagaaatgtgtgggtaagacatttgtacgcaaaaagccgaacatgcaagtttcacctgttcggcattcttacgcgatcattgaagcacagcactcagtaggcgtttactgggcagctttaaccccttgatgatccgcttcggcttcagctttataagccgccacttcgtcatcagcggcaaaaatgtaatgttcaggataaacctcaaccattttacgtttcttgttgtcgccttcgaccttgctggcgtcatacggcagcggcacgcgtctgcgctcaacatctggatcaggtaccggaatcgctgagagtaaactcttggtgtaagggtgtaacggatgactataaacttcatccgccgttgccaattcaaccaaccgtccataatgcataacagcgatacggtctgagatatacttgaccatcgataaatcatgcgcaatgaacaggtacgtcaacccttggcgatcctgaatgtccttcagcaggttgacgacctgcgcctgaatggaaacgtccagcgcgctgatcggttcatcggcgataatgaacttaggctgtacggccaatgcacgggcaatcccgatccgctggcgctgaccaccggagaactcatggggatagcgagtcgcgtgatcagcgtttaaaccgacttcttccaacaactgctcaacttgatgatcgcgatcagcgttgtttttggccaaatgatgaatatcaatgccttccgcgatgatgtctttgactttcattcgcggatttaaggacgcataaggatcctgaaaaatcatttgcgtggctcggcggaaagccagcatctgtttggagccatttttcagtttggcaatgtcgttgccattgtacaaaatctcgccgctggttgggtcgtacaagcgaatgatcgcccgaccagtggtggttttaccagaaccagattcaccaaccaagcccaatgtttcgccttcataaatatcaaacgagatatcctgaatggctttcacttggtcttttttcccggcattgaaggtttgaaccaagtgcttgacggacacaagaacctttttgtcttttttgtcgaccacgttagttcaccaccttttcatcttgatgtttacttgcccataaggcatgtcgccgcgcaatttctggcggtaattccactttcggtgcgcctggtgctaatagccaagttgccgccgaatgggtcggtgagatcttgaagaatggcggttcctgctcgaggtcaatcgccatcgcgtatggattccgcggtgcgaacgcgtcaccttttggcggatcaagcaagtccggtggtgtcccaggaatggcgtacagtcgatcactcttggtttcaagtgttggcatagcttcaagcaacccccacgtatacggatgctgagcattgtaaaagatttcgtcaaccgtaccatactcaacaatcttgccagcatacataaccgcaacacgatcggcaatcccagcaactacgccaaggtcatgggtgatgaaaatgattgaggtgtcgatcttcgactgaatttctttcagcagatgaataatttgtgcctgaatcgtcacgtccaaagcagttgttggttcatcagccagcagaatctgcgggtgattgatgatcgcaatggcaatgacaatccgctgacgctgcccaccagagaactgatgtggatagtcctttaagcgaccgccagcatccttgatgccaaccaaatccaacacgcgttccgcttccttgagcgcatctgctttactgattttactatgcaacagtaacggctctgccacttgtttcccaatggtcatagttggatccagtgaggtcatcgggtcttggaaaatcatggcgacatcattgccacgcattgcattgagctgtttctcggactttttgagaatgtcctcgccgttaaacagcacttcgccatgcgtaattttcgcatttggggctaacaaacccatcaccgttcgcacggtaacggatttaccagaaccagactcaccaacaatggccagtgtctcacctttgttaaggtcaaaattgacattgcggatggcgtggacagggccggcataggtggcaaagtcaatctgtaaatcttttacttctagaattttactcattttgccacctcctaatgttcactgcgcggatcaaaggcatcgcgcaaaccatcagccagcaagttgaaggccagcatcagaatgacaatcacgatcgccggatataacagctgatacggcagcacttgcagattcttttgaccatctgacagcaaggtcccaagactagcagtcggtgctggcagcccaatcccgatataactcaggaaggcttcaaagaagattgctgtcggaatggtgaacatcgtttgaatgataatcgttgaactcaaattagggatcagatgtttaaaggcaattttgatgctcgactcgcctaacgttctagcagctaagacgaattcctgatcttttaactgcaacgtctgcgcacgaatgagtcgagccatggtcacccacccagtgaaggcaatcgctaagataatggaggtcaaaccaggacggaagaccagcagcatcaaaatgacaacaaccaagttaggaatactggagatgatttcaataacacgttgcatcaacgtatcggtcatgcccccgcgccagccggagatgatgccgtagaaaaccccgatggtcaaatcgaagaaggttgcgacaatcccgatgaacagtgaaactcgggtgccgaccatgattcgagacaacaggtcacggccaaggtaatcggtgcccagcaagaagtagacatttttgcccatgccggcgtacttgttttgaccgttcatgtagccgttcaaacctggcaaatcgatacctggccatttgggcggcaggttcgcatagttcaggctttgcttgtttggattagaaggtgataaccagatagaaatgatagaaatgaacgcgatgaaaacgagcacccacaaggaaatcactgcggccttgtttttcttcaatcgccgaatcgcatcttgcgtgaacgtcagcgcaggcgtggcaatacgttcctgttcagccgcatccactttaacatgcttgaatgcatctggacttaatttacttgttgccattagtttgcctccccgctcaatcggattcgtggatcaatgaagccgtaaagaatatcgacgacaaggatcacaaccgtcagcatggcactgtagagaatggtcagtcccatgataactgggtaatcgttggtcgtaattgacttaacgaattgttccccaatcccagggatcgcaaagatgttctcgacaaccagtgagccgaccattaagtcaacagccattggtccgatgatggtcacaatcggaatcattgagttacgcagcgcatgcttggcaacaacttgccagcgtgattcacctttggaacgtgccagttcaatgtaatcagaactaagcacatcgaccatttcagttcgcatgaatcgggccgtttgggcaagcggtgcgatcgccaaggcaactgtcggcaaaatgctataagagaagccgccccaaagtgctactgggaaggcgccagttttgaaagcaaaaagctgcagcagtgcggcgaacacgaagttaggaattgagcgaccgagaatggcaaaaatggtagcagtcgcgtcaacccatgtgttcttgcggatcgcggcaatggcaccaagcaagatcccggcaagtgtgccgacgaccatcgcctgtgcaccaatttgtagagatggtccaatccgagaagcgattaagtttgacacggtttggccaggaaattgataggacattccaaaatcgccatgtgagattccgactatatacgttaggtattgcatccaaaccggcttatccaatccatactgtttcttcaaaatcagcagttgatctgctggaattttggggttgttaaacggcgtccccggcaacaacttcatcaggaagaaggtagcgctggcaacaataaacagtgtcaggagcaggaagccgatccgttttaaaatatatttggccatgattcactcctgtttatgggcacacgccctgataagcaaacagcgttgtccgccgcagaacacgagacaacgccgtttgtgagaactacttatttgaaactagcaggcagttattcgtaactgctcacgttttggtttaaaaacgcggttgttagaccataatccgactaagttctacttaactttcgcattcacaaagttgtaggaattggttgggttgtaattcaaaccggtaatggtcttacgctgcaaggttgtttgtacccgttgatacagcggtacaacgccttgttccttcgtcaacagttcttgggccttgagtaaggtgttccaacgagcggttgcgttggtcgcatcggtcgtcttggactgcttgatcaaagcatcgtattcagcatttgaccacttgccatcgttgtaactgttatcggaggtgaacagatccaagaaggaaatagcatctgggaaatcagcactccaagcggagataaccatatcgaactgaccattttgggaacgagatagacgcgtcttgaatggtactgtagcgatggtaactttcagacctggcaggttctgttgcaaggtgctctggaagtattctgcagagcgcttagcattggtcgtatcgtctgtcagcagttccaaagttggtgcggactgaccgacttctttcaaaccttctgtccacaactctttagccttggctggatcgtacttaacagcggaggattcagctttagatgccgtcttggagaagtcttgaccgttcttttcgaacaatccttcaggggtcacattgttggccgcgatggaagcatcattcagaaccttcttaatgtatgcctcgcgatcaatcgacatggaaattgcctgacgaatcttggtgttcttaaagattggatccttcttctcgttcaattcaagatagaaggtcgcactttgtttgaggcctttgaaatcagacatggattttgcttgagccgcttgttcaccttgcaaagctgcgatatcaagtttcttcgactgatacaagttcatcgcggtttgcgaatccttaacaacttgaccattaagggtatcgatgtgaacgttcttagcattccagtaagtagtgttcttagtttctttccaagtgttgccagtgccgttccagttcttcaactggtaagggccgttggacaagatgtacttggaagtagttccgaatttcttaccagatttttcaacgaatttctcattttgtgggaagaatgctgggttaaccaacatggtcttgaaataaggaatcgcgtgatccaaggtgactttcaaagtcgtcttgttgacggcggtaaccccaagcgtgctggccgcttttttaccggctgtgatgtcatcagcgtttttaacgccagaatataggtaggcgtattgcgacttggtcttcggttcaaccgtccgccgccaagcaaacacaaaatcttgggctgtaactggatcaccgttactccatttagcattacgtaacttgaaggtataggtcttcccgccatcagtaacagttggttgactcttggccatggcattttccaatttgctgccattgtaccgatacaagccatccatggtatcaatcaatgcctgaccagaaatagcatcggtggtcgttgatggatccatcgtggagatcacatcactctccatccgtgtaatcgaagtacctttactgctgctagaagaattagaaccacaggctgctaacacccctgcaagcgcgagcgcagagcccgcaaccattgtctttctaaatttcatcctgttccctcctaaaatgattgaacttaccttacattagaaatccattaatgtaaataagcgaatcctcaatttcgcctaaaaaaactaattctttgatcttacttttgtcacatttatgctaccgatctcaaattaaaaattgtatatcccgtaaatattctctagatggattccttatttataggcagtaagaagcccacctaagctaataatcggcacgcgtttttgttttcattttgattgatgatgctaagaatagcttatattaaataacactggcaagaatcgaaaaatcgtcaaatagtggactaatattcggcttttgctcatagaattttcgcttttgtcagacaagctgccatcttatacaaataaagctgagcaaatgctcagctttatttaaccgctttcatatgtttcacttggatttattgaactgaagccttcgttcgccgactgcgaattgttcgaaaaatgacaattattaatccaacaacggaaacaatggttgctaaccagaaaacaaaggccaatgcatgcaggaatggtgcccccgactgcggcgaaattcgcgtgacgcctggcaactgggcaaaaagtaacgtagcaccaaagctgatgccgatggtcattccgatggttcgcgccaacgagttcagcgatccggccacaccagagacactggcatcaaccgcccccatcgttaaggcattgtttggcgaaaggaacaacgccatgcccgctccattgagcacaatcggccagatgatgggtgccatcgacaattttgctggataaaaggcatagccgacttgtgacacaatcaggactaacaagcccagaatcgtgagatagtaacgattccaatgatcggcaagccagccggcaaacggtgtaatcatcaacatgacaacactttgtagcatcatcaacaggccgctttcaaaggcagaaatgccgccgtaactttgcaaatagaatggcaacaaaatgttggaaacggagttaaccaacatgacgatcagcagcacgctgacggatattaaataatcgggattatgcatcaatgctggcgcaatccacggtgacttagcacgttgatcttggatgaaagccaacaacgtcaaaatcgctccaccagcaaggatgagaaatcccaacagatgttgcgtcggctgctgaagccaatagccactggcaaaggtcaagatcatcccgccagtaaacagattttgccctgtccaattggcgttaccccagacttgcttaatctccccagttgctggccggcgcagtggcaaaagtcgcatccccgcaaacacgattagcagaccaactgggacattgaaaaggtaaatccatcgccagcttgcccaagtaatcaaaatgccaccaaatgccgggccggaaatcgacccgacggaaacaaacattgagatcaccgctaacgcctctgctcgattagcatcaggaaagtattggctaacgatgcccatcgaattcgccatgatcatcgccgaaccaacggcttgaataacgcgaccggcaaggatggttagataagtcggcgcgatcccagttaacaatgaaccaacaatgaataccatttcgccgatcaaaaagacaagattttttgagaccaaatcaccgatatggccaaacatgaccagtaaaacagaggtcgtaatgaggccgatggacacaatccaagtcgcggcactgctggaaatcatgagatccgccgaaattttcggcatggccaagttcgtactcgacccagacagagccgttaataacgacatcatccccaaaacaattaaaattttaattcgttgcgcgcgtggcatggtcatcaccatcacaccctttcggactgtattttaggctaattggtcaggagtcacaattattctaccttggtgtgacggggtttgcttgagctgctcaaccacctggccgtctgctggcacgcgttgattcaatgaaccggcaagcgatcgcgcaaccggctgcggcaaaaagacacgtttttggataacaaaaaaaccacacagattattcactgtgtggtcagcttgcttttgaaattatttttgagcgcggcctttgtaagttcctgtgtcggtcgtgacgataatagtttcgccatctttgacgaaatcaggtacggtaacaactaagccagtttccaatgttgctggcttgccgccgcccgccacagtgccgcctttgacagccggctgggtttcggtgactttaagttcaacgctgcctggcagttccaagccgatgacttcatccccatagaattcaatttcaaccggtacattcggcagcatgaacttcaattcatgctcaatgcttgaagttggcaattcatattgctcgtagctgtcgctgtccatgaagtaggcagtgtcgtcttgcgtatagagataagtcgcctttttacgatccatgatcgcaatttcgactttttcgcttggccgcatggtggtggtaacgttagcgccggaacgaatgtcgtagagcttcatttgcatgacggtattgcccttgccaggcttgtggtggttggattccagtactttgatgagcttaccatccttaacaaagaccatcccagatttcaaatcaattgcttcagtcatattttgtgttctccttcattcgcattacgccgcaacggcgcgtttcgtgtttagtataccatagtgaacgatagcgctatctttttgaaacaatctaattggcaagctgatgtttggctttgtgaacaccgttagtacgagctggctccgaggcggcaggggctggcgaccacgaaggtagagtggtgggcacgacttcaagcccgcaaaaaccgcgatctttctacgatttggggaaccactcttagtttccagatcttaaggtgtctttacggacatcaatttgaataacatacttaagttactaatatcgcagagtgaactcaaaaaaggctttcccgacaagcttactttggtgagacaagggttctacacgaaaaaagcctgcttcttctctaattgtgtcatcacaacaaatcatagagataaacagacctccaaagactattaacgcgattgagccaccaaatagaatctagcctagagtaaaacttaggaacacacagggactagatattttcttttgcaaaataaaaaactcagagacacctattcacgcatatgtcgtctgtttttaaccgaacccaatattcggactaaagcaattacaactgttccaacaagaactaacttcatactattggaaaatatgccggcatgttgccatgttctcaaaatgaatgaccctaacaaaacgatcacacaagcaactaaaaaagctttgagttttatgttgttcatagtaaataacttccaatccgctgagaaaataatagatattgctaagcctagcaaaaccattcccacaaaacaataccaatgaaaagtggctgggtcataattcttagtcagatatcaaaaacgaacgatttcccgcttattggaaaatcgttcgtttttgacttctcatgaattatttattgcgattttaaagaccgtagtgccaaggcggagcaatcgtaggccagatgggactcagccgcgcaaacaacacagcgaccgggctttgtcgctgatgttgttaggcgacttcgagaccgcgggctttgcgggctcgaagcgccgtctccgctctagctccgcgtcgccaccccagctggcaggagattgtggggtttggcacggcaagaaagttttagcctagcaactttccacgattattcggaatttaatgaatcacaggtcttgcaagggaattatggctcagcctcttttcggttacatatcctccacaaccaagtaagtcatgtccaacgggccgtggaccccgacaacgagggtcatttcgatgtcgccagagttggatgggccggtgatgaagttgatgttgctggtttggagcttgccggctttaatgtcagcatcgtagtgatccatagcttggcgagaacgtggcaggatgttgctctttttgataatagccaagtaatgggttggcaggaagtggaagccacggccttggccaggggtggtggcaacggtaatcgtgcctgattcagccagcaaataatccgcaaagccgatggcgacgtccgcagccgccgcttgcttcagattgaagtcgcggcctttgcctggcgtccagtacatcggcttaggactgacggtgttggtccattcggtcaagccaaaatccacgtacttgtcagtggttggcaaaatcattgttttaggcgcatcttgctcaatgtaagcatccaaggcagccgccaaatcagctttggtggtggttttaaacgtgacatgcaccccttcgctatttttcttagcgatggtttccagctcatcttgagaatggccagacaaggttgtttctggcagatcattgagcggctcaaatggatgatctttgagctggtgccgcggtcggccggctttttcagcgatggcgttcaaaaaatcttcccgattcgtgtgatcactcatgtttttgcgcctccaatgctgccttgtgctccttgaaccagtgacggaagttctcgttcttcttcggtggccgtggcaggtcacgcacatcggtccagccgcgtgcgagtttcggcaacatcttagtttgtttgatgcgaccactattgtactcattttccacgctgccttgatccttcgtagccaaaacgcccatcatggcatgatccatatcaagcgccatgttgaataaaaccggagcgctagtgccaacgccaaccattttcatgatcttgtcgttgaagctgtgatccatcttgagcttatccatcatgacttcacgatgcttgatcaacaattcgtgaagcggaatgcgaacgggacaggtttcggtacatgctgcgcagaggctggaggcaaatggcaagtcgccgaacttttcataaccgtctaaaactggtgaaagcaccgcgccgattggtcctgggtagattgagccgtagccatgaccaccgatatgccgataaaccgggcagacattgagacacgcgccacagcgaatgcattgcaagactggctcgaatggcgtgccaagggcgttactgcggccattatcgacaatgaccacatgaaaatcttccggtccgtctgcttcgccgtcaacttgcttgccagagaaggaacaatagctggtcagtttctgacccacagctgaccgagacaacatgttatccagtgtttctgcttccttcaaacttgggacaatccgttccatccccatcacgaccacctgtgtcttaggaatcgccatggtcagatcggcattgccttcattggtgaccaaattgatcaacccagagtcggcaatcgcaaaattgcaccccgtaataccgaaatcagcttgtaagaaatagcgccgcaagtattcacgcgcgaatctggctaaatgttctggatcgttgtcacctttgtaacccagtttatcgaaatggttttgacctgatcgcggtttttcgccaatgccgggaaaacgatgtgggttggttctgcccaatcgtcttcttgcaaaataaactcagccaaatcagtttccatcagctgggtgccaggaatcttcaacaaatctttgtccaaattgatttcggtggtgaccatcgacttggacttcacaatcttcttggcctgcttcttcttggcaaggttcgtgatgtaagccgcggcttctttgtccgttttggcaaagtaaacgtgcccgccgcgtttttcaacgttatcgctaaattcttctaaataatccggtaagtatttgatcacatgctggcggatctgttcgccaagatcgcgccattgcggccagttgccaagttcgtgacgtgacgcctcgcgtttatcccactgggcgtcttgtgctttggcaacactcgcctgcatgaacttgtcctgttcggattctttcacccgctccaagaatggtttatcactggtaacgatactcataggcgcacctcctgttctaccggcagtggatcatggaacttgatccgtttcgggtcaacattgtggttgagcacttcagcaatgtgcataatcttaattttttcctgacgacgagagaagcgaccggaaatattcatcaagcaggctggatcagccgaaatcaggactttggccccagtactcagcacatcgtcgactttttcatccaccatctgcttggaaatctccggctctttagcggaaaacatgccgccgaagccgcagcagttttcgatatgtgggagtggttccatttgcagatccttcacatgatcaagcaaaacgaatggtgctgtccgctcacccaacaaccgggtcatgtggcaagagcgatgataggtagctttggcatcgagttcagcgcctgcatcaatcacattcaaaacccgatacagaaactgggagaattcaaatgttttgtcggcgacttccttcgccttttcagcatattccggatcatctttaagtaaaacgcggtattcgcgcagcatatttacgcaagaaccagctggcccgacgatgtaatcggcgtcaactgacagcaacgcatcgatctcattacgaaagaccttctgcgtagctttcacgtaacctgaattatatgtcggctgaccgcaacaaatctgcttaaccggcatgaaggtttcacagccaaagcgttccaatacttcgaccattgctgccccgacgttcgggaagaaaagatctacgatacaggtggagaaaatgacaactttcatggcgcacctcctatattaaaacgattccaatttaaatatacacctccaaacatgattacggtactgaaagcgtttataaaaaaataatttacttctttttgaaatcgttatactaactagcagcgaccagccaatgagttcactttgaaaaagcactgtttatgctagcttttgatactaggtttaagcatattgtttcttaagcacgatactgcccgtctgaatcacgctgacaactaggcataactgccactaacatccacaattaggctgtcaccaaaaccaacgacatcttgtggctcttttgctgctttattaactaaaaaaatcaactttttaaaacggtctataccccctctccccccttgacttgacgctgtttcgcacggtttcacagccttgatttttaggctaaaaagactatggtaaaggtggagttaggaaaccctaaataataatggaggcgtgtttatgcgtaagcgatatagggcaacgttacaggcgcttaatgatgattgtatcggtcggaaagcacacgggtttgcgaatcttgaagtcacggatgatgatgccctgcaaattcgcatcaagatgtttaatacgccagcagatatgacgcatatggccgttttggaaggttccgttacgaaagcgccagtcgcggttgcgacagccgcgcaagacgtgaaccatgatggtgtcgttgacgaggaagaagcagagaaggtttccggtaaagtgtttgtgccactcgataatgctcctgagaagctgaatctcatcggtggtaaatatccagaagccgacgacaatggcttttacatttaccagcagcgagttgtcatgtcagacttgcggtaacagttgctcaaacgttatggcacggatgtcttcaatcttgataatgcggtcatgtatgttgacggcgtccaaagcgatgtcctgttgccgaaaacagtgatgagcgatttggacaaagagaaaccttatctcaccttgccgattgccgttggtaagttgcgtaaggtgatgggttgatcattgtcccccaatatgggattcgtgaaaaggttgggctaaacaattttctgtcgtgccaagctctgtagtcgtagactttgatctttcaagcctaaaaggcactgtggcgtgggcaaaaattctttgtttcggtaattgcaaattttgtcctgacctgttcactgtttcttgttagctttacaccattcaaaaaagccgatcatcctctgaccggcttttcgtttgtcatttttgtgttgcgcacacgattacacagttggcgctgttgtcatttccgccattcgctgataaacagcgacaacttcacccgccaaatcgcggaaagtgatggcattcatgaggtgatcctgcgcgtgaaccattagcaatgacacctcggcatgatcgccgctcgcttcggcagtcagcagctctgtttgcgcattatgcgctgacactaatgcatcatcagcttcttttaactgcacagttgcttcaggaaagtcaccggctttggcagcttgaatcgcggtgaaggccgcacttttggcattgccgcctgctataatcaagcccatgatcgtctgttcattcacttgcgtcatcgtgttttctcctttgtcatgatcagtgtttgttaactcatcggcggtttgtggctctaacttttaacatgctttaacatgaacgtccgccatggtttcagcaacggcaacaagtcgagatctaagtcagttaattgaccaattttattgcgtcggccatcatttgccagttcacgcaggacaatctgcagttctccggcataacgggcatacgtttcattcaccacgacaacatcgccacggtgtaacgtgccagttgcatcatgcgctggaatcgcctgtcctgcatagcgaacgcgtggttgggtgtcgcgaaccagatagtctgaggcgtcaccacgatataaatgcgcctcactgaatgcaatcttggtttccaattcagaaatggccgccgttggatgcacgcgcaatgccggatacggacagaagaaggccagtgccgcggcgtgcaaatcagcctcgctcgccatcgcattgccgattaacacatcgtctatcacctcggtcagtcgcaaatggtgcacctgactggcaatggcccgatcgcgatcgctttccagtgtcggcaagccttcgctgatcggccacggcccatgatcagcacttggcgcagtcacaaatgccgcggtgcgaatgccataatgtcgaaacttctgcgagtaggccacaaaccgctcatcacccaaaccagtatattgctgcgggtaaaaattatggcagcctaacaagttatctagacgtggtccaaacggcataatggcatcaacataattcgtgccagcactcatattgatctcaattttcaagccatactggttatgcgtcatcaacgcctcttcttgcccagtaaatccctcgtcaagccgcaagccccagacgcccagttcgtgaaagaaactcagatcatgataatcaatttctaactcggaaaataacgaaagaaactcagatcatgataatcaatttctaactcggaaaataacggtggtgcaatatcgacaatcgttttaaatccaagttgagttgctttggcaacaacagccttaaaaatggccaactgatcgcggcctttttcgccagacaactgcaatagcgatgtaaacagccgccgatagccaaactgatgagccatttctagataagcagtcgcctttgctaccgtggtttgttctgggtagagactgatcccaatctgtcccattttttcgcctccctctgtcgagtcattgttttttgtttcactgtcttgtattgcttgcttcgtgctccgtgccgatacacatggcgtatcacctctaaaggcaacctttttaagattgacacatcttcaaggccattttcttgaatcggcgtttccgaaaccagcccatcagtaggccgctcacccgattattggccgtgcctcgcgccgtttttgcgactaaggattcttcatattccaaccgactttttcccgatgcaagtggcactaggcgatagctaacgcgaaagtcgtcttgcggcgttgctaatgtataagcatagactttgttcagctccatgtcggtaatctgcagccgcgcctgccgaccattcggccattttttagcatagctaaacccgcgcaaacttcccggtaaaggttcccggccggtatgcgtgcgaatgtctgccaatgccgagagctgtaactgtttgaaaaagaccgccggctcaaccggcagattcatggtgatcttcatcgcgcccctcctgcttttgtgccttgatcaactgaacatagcgacggacgaacacaatcgttaaaccaatgccgatgccgcagccaacgatctgccatggtgctggcaataatggactgaacatcacgatggccatactgagattgagcaagatcaagtttgctgtcacatttttcaaacagcatcaccttccagcttgcctgtctccttcacgcgtttttcttttttcatcaccggttcgtcaacggtcaactcagggtccaacttgttggctgctttgacgaatggcacatagatcaagaacccgatgaccatattgactgcctgtagaatcggtgcgcgccagtccatggttgcaatcagcgagttgacaaacggtggcattgaccagacgatttgattcttaactggcgatacccagccgagaatgtgggcgccataagcgattgagaccatgaccactggcgccaaaatgaatgggatgaagtaaatcggatccagcacgatcggcaacccgaacatcaccggttcattcacattgaagcagcctggggcaattgataattttgccacggtacgttgatcgtctcgttttgaaaacaggaggatggcaatcagcagcagcaaggtactgccggcgccgccaatccatgcatacagatcaaatgcgtttcgggtccagacaaacggtaacgcttcacctttcatgaacgcattcatgttagcaatttgcgcggtcaaccaaatggaatccaacaccggtccgagcacattggtcccgtgcagaccgaagaaccagaagatttgcaccaacagtgtcatcagtaagactgcccagaaaccttgcgacatattcagcaatggttcctgaattaaggtagcaataaattcgatcaccgttgttttgtttaagctaatcagatagttgatcacaccggctaaatacaacgcagccgttgctgggatgatcccggtaaacgccttcgcaatagcaggcggcaccgcctctggcatcttaatcgtgacattctttttcatgagccagatgtataaggtcatggcgatgccgcccatgatcatgacggtgaagaagccataggaaccaaagaacttgccaaagttgaagtaaccccacatgctgatgttcttgccatcaacaactccaccagcatcggtaatcaactttgtagcgcctttaccaagtgcactgcttaaagcgactgtgaaattctgcggtaaactcatgatgaatgcgcctagtaccacaatcccgccagtcaccggctcaacttgatactggactgctaattgatagccgaacgtgaaggcaaacagcaagcctagaatcgccagtgtgccggtccagaccatcgcattaatgccgatcagccattgcattgaatcaacaatgcccatccacttgaactgggtcggaatatcgcgaattaaaacgttcaagactgtcgaaactgcgccggccatcatcgctggcatgatcgcaataaacgcgtcacgcaaagcaactaaccaccgaattgatccaatcttagccgcgatcggcacaacatgccgattcagccatccaataaatgcattcataaagatgcactcccctcgaatattttttgataatgtcgcagtcattctttattacaattaaaattttacgggagtgctggttcgcgggtcaaagataatagtagttattatttataatttctataagcaaaatagttgaggcgatctgttcttgtgttggcttggtgaacacccttagtccgagctggctacgcggcgattgggctggaacgtggtgggcacgacttcaagcccgcaaagcccgcggtcttgaagctcggccttggtctaagcggagaaaaccactccgcttagaccaacgtcaccactgagcccatcgccgctccgccagctctctgctttctatcccagaacttgaacccgattgctcataattttccaggtacaagaactactttttccacatcgaaagtcgaattcaagagcggcttcttattaatatatggacacgaaaaaagtacttcctacagcagaaagaaagagctggcggaccggtggcgggctcagccttgaaattgttgttggcggtttaccgcctacaacaaggccagactttgaaatcgcgtgggttttgctggagttcaaagctgtgcccacggctctagcttcgcggtcgccagcccccgccgcggagctagctcgttctgtcggtgttcaaacagcccccgtaagaaagtaagccctcccccgatatcacaagcagctcgacggccattcgcttataatagattgaaaccagtcaccataacgcgctcgcagtcgcagaaacctgctcgcgctttccatcatgggggtaaactttatggcaaatattgaatatgatccggaacgtcaattgtttcatttgcacaacgacacctttagctatgtcattcaggttattcgcggttatcttgttaaacgttactgcggaccggcgctggatcatttttccggtaccgccaaacttgaagacttcagtcatgcttttaacattcaaaatgatgccgcaccttactcactgacgaccttgccgctggaatatagcacattgatgggcggcgattaccgtacgccagcttacgccgtgcgtaacagtcacggtcagctgattggtaatctcaagtttgaccactatcaaatccttgctggcaatgaaagctttaacggtaccttgccgacagcgcgaacaccgcacgggcaaacgctgatcataacgatgcacgatgaaacccagacgcttgctgtccggctcaaatacacgattgtcggcgatttgcctgtcttgctcaaacaagttgagtatcgtaatctgacagacacgacactgacgattactcatgctgccagccttcaactggattttgacgaccacgcttatgacctcattacgctgaccggtgctcatctcaatgaggccaaagtgacccgccagccgctgacccccggcaaaaagtcaatcggcagtaattatggcgccagtgggccgcaaggtgtcccggcgacgattcttgcagcgccagcgaccaatgaatttgctggggaagctttaggcgtcacgcttttgtggagcggcaattttaactatacggcgcaagtcgatcagttcgacaacagccggcttgtgatgggactgaatccggagctctttgcttggcagctcaagcccggcaagccatttgtcacgccggaagcagccgtcgcttacaccaatgatggcctaaatgatctcagccggatcttccaccgcttttttgccgatcatgtcatgccattgccgcgcaaaaacctaattgaatacaacacgtgggaaaccacttattttgacgttagcgaagccaaaattcttgccgagattcccaaagcggaagagttaggagttgagttactggtcattgatgatggctggttcaaaaatcggcctaacgatgctggccaacttggcgactgggtacctgatcccgttaaatttccacatggcctgcgcccggtggctgacgcaattcacgctcgcggccttgcttttggactttgggtcgaacccgaaatgatcagcgaaaatagtgagctctatgccacccaccctgactgggccatgcaatatgtcggccaaaagcctttgcgttctcgcaatcagcttattctcgatctcagtcagcggattgtgcaggatcacttgatcacagttctaactaacctcgtgcgcgataatcacattgactacctcaagtgggactataaccgccacttcagtcaacctggcagtccggtgctgccacctgatcaacaaggtgaagtcggctatcgctatacccgcggcttataccgggttttgaaaacgttacgcgacacttttccaaagctactcatcgaaaattgttcgtccggcggtggtcgtttagatggcgggatgatcgcctacaccgaccaaacatggaccagcgattttactgacccggtttaccgcatgaaaattatgaacggcttctcgctgtttttcccgctcaaaatttttgtctcgcatttcaccgcctccccgaatctacaagatgcgcggttaacgcccttgcatacccgcgcactgttaagtctggttggcatcactggcatcgaatgcccgccgagtcagctcagtcccgctgaagccgcggcggtcaaggccagttttgccttttacaaagcgaatcgcaaagaattgcagaatggtttgctttttcggttacgacctagccatgttaatcaagacgaggtttgttggctgatcaccaacgctgccaaaaccaaggcactggtcttgacttcagtcggtgtcacttcgccgattcctcattatcaacatgtactgctacattacttggacccaagattgtcttatcaaattgacaacacaaaaaatgccaccgggttagaactgaaccacgccggtgttaccttgccacttgcccatggtgatttttcggcaacgctcatggagctgacggcagtaaccaaccttccgcaacccaccgcagcaccgacgcttgatcaaataaccacgcaaagttagaccatcttgttgttcaagcatgaccgtttaatctcagccgttagaaagtgagtttcgctcgcatgaaatttatcatcgctcccgcaaagaaaatgatccgcgctcaagacgatttcccggtccaaagccagcccaaataccgtgcccaagctggcgagctgttgctgctgatgcaacaattgaccttttctgaagcgcaggcgctgtggcataccagtgacaaactcacgcaaaccgcctacaaccaactgcagcaaagtgacctgactcgccaacagtcaccggccatcttcagctattctggcattcaataccaatacatggccccggacttgctagacgacgccggactggtgtacattcagcaacatcttcggattttgtcaggactgtatggcattttgcgcccattcgatggcgttgtgccttatcgcttagaaatgcaaaatcacttacctctgcctcatcatcgcaatctatatgacttttggggcaaccgcctttatcaggctttagccagaatgcccggccccatcatcaacctcgcctctgacgaatatgccaaagccattcgcccctacttgcaagcaaaagatcaattcatagatgtccgtttcgcccatcgcgttaacggtcaactaaaaacccgtgccacttatgccaaaatggcccgtggtgaaatgattcgttttgccgccagccatcggttaaccaaggcggcggatttgaaacattttgattccccgacttatcgcttcgatgctcacctttcaaccgcaacacaactggtgttcatcgcgaagtagtctttataaaaagctggcccaaattgcctttgatgagtatcaccattcccgacccagtctcctttggccggtaatgatgtgaagaatcagccatcattgacagtttgagtcagtttttttgcgtgcgcggcctcgcgctcatgccccaccattaaactcatcgcatgtgtcaaaaaacgcttctgtgcaggtaaaaagtcatcagcgagctcaaaacttgcagtttcgcaaaatcaaagttaatatataaacaaatattagaaaggtttgtttatatggaaactttaaataattttgtttgcgaaaattcagagctagcgcacggttatcggctcaacaatcatcattaccagtgccgctactgtccagtcacatttgctgcagatgaagtctatccgcaagatggccattttttcacagctgaagccatgatccgtcagcatgtcgcccaagtccatcatggcgcgcttgcagcgttagtggcacaacccgctggtcagcttggggtgtcatccagtcaacagacagttttacagttgttcgcccagggactcagtgatactgtcatcgcgcaacgactcaaagtctcaccttccaccatccgcaactaccgctttaagttccgtgaaaaggcgctacaggcacaacaatttctcgccgccatgacgctactagcgatgccagacgcgctgatcatccctcacgacggtgcaaaaatggtcgatgatcgatatgcgatcacgcctgaggaacgaaccaagacactcaaaagtttcatggacgctgatggtcgcgtgacgaattggccatcaaaagagaaacgcaagctcattattttatcggaaattttcaaaggcttcgatccccagaagaactactcggaaaccgcggttaatgaaattcttaagcaacatgttgatgattatgtcactgtccggcgtaatttgattgaatacggctttctcgatcgaaccgcagatggccgcacgtattgggtcaaggctagtggtccgcgaatttaagatagcacgataaatgtgttcgcgggatattcaaaaaagaatttagaataaagattctgcgccgtgccaaactccgcaatctccagccagacggggaggcgacgcgtagctagagcggagccggcgcttcgagcacaaaaaccggtttcgaagtcgcctaacaacatcagcgacaaggcccggtcgctgtgttgtttgcaccgctgagcccaatctggcgtacgattgctccgccttggcactgaggtttttaaaaagttatcgtgataagccgaaaggcgagggattttccgaactctcagaaaatccctcgcctttatttgtcttccatgaatgatatgactatcaaacatcccgagcaggttttctagccggcaattgagcaaccccatcgataatctgatccaagatgtccagttgttccgcataacgaacggcaaatggctgctcgcttggtttgacttcctctgcttccagcgcgggtcgcgtggataagcgttcagcgtgccgcttatccagccaagccaagacctgatcaaaggtatagcggctgaacgtatcgactgtcagttggccggatagaaaactaccaagtaaatcatggcgagcatcgatgggatagattttggtgcgggctaagagcacccgaaagtcaccaaaaaagatgaattgctgctgggtgcgcgtcaacgccgtataaaagctttgggcgttgagcatcatgtcggcgccgttgacaatggcaataacggtatctgcctgcccaccttgggccttatgcaccgtaatcgcataagccagcgtcaaatcgcgcggcacgctgccaaaactgtagtaacaatattgctggccgatttggaccacaacaaaatggcgtttggtatcaatatgggctaccacccctgtgtcgccgtttgccacaattgtctcacgccaacgtttagtgccaaaatcatcggtctgttgcaagccattttcgcccagcaccgcacgccgttcccatgttttcggatcaacaagcgggacatgtttgtcgtttttcaaaatcatgacccgatcattgaggcgcaagtgatgtttttgattagtgaccgggtccacgtaactgctgatatactccggttcgccatttttagccgggttgaccaacgcttgcaactccgcgttaaatcgcaagcggccagttgcgccgatgtttttattcacgatcaacaattgcgcatcaatctgctgaccacttttgaccagcgcatcctgatacgccttcaccccagcatcaaacacccggccagcattgcgttggttatacagcgccacattgccgctgacatagcgatcatcgtctggtccaaaaggcagcgctaaccgctcacgaatgcgattagctagtgctaacacgccggactggctatcttgccgataaacgcgcgtcagtgttgtcgccgccacctgttcatcgtctagacaatcttttaaaaagttgccaggaccgatgggcggcagttggaaaacatcaccgacaaacagcacatgcgcctttttgaaattaacgttcttcaaaaccgtgtacgctagcggcgttgtcagcattgagctttcatccaccacaatgagtcgcgcatcgccaaaggtttcccagtcggcatccgcgtcaaactggccggtttcttcacctggaagcaaatgcagataagcatgaatcgtagcagccggctcgtgcgtatactttgccaaaactttggcggcgcggccagttggtgcaagcaagacacttttcccttttgcttgggcgttaaaaaaccgaaccagcaaatcggtcaaccaagttttaccggtgccagcactgccattcaaaacgctcaagccatgacggttcacattttgaaaagcggcgcgctgctgatcattgatggttaaatgaaaccgatcgagaaactgatcgagggcatcatctagctcatccggagccatcagcggttcggctgttttttgagcgactttaataatccgcgccaccgatccttctgtggcaaacatatcgcaactcgtcaccagtccatactgctcgttaagtaaaaagccgtattgcaaggcttcttgcggatcagcaaacattttcaaatcggcttcgcgtacagccaataaagtagcagcttgctgccggaaccacgtaatggtgatataggtcaatccttgcgtgagtacagcggtgcgaaaaatatattgcagccctgccgtaagccgatgcggatcattcgctgcaataccacgcgttttagcaaaggtgtcgactttcttgaaatcaagctgggcaactgacatcaacaggtacggattggcatcaatactttgcatggccaaattggcatctttataagccaaccaaattttttcataagtcattgagcttagtgccttgccccagtgattggccaacacggcaatttccagtttgccgcggatggcagtagcgattttcttaattgtggcgggaccaatgcccgggacactatccggttttacctgatcggttgaaaaaatcgtcaagatcggggtgtcatctgcaaaatgttcatgcaatcggcgccggactgtcggctgatgcaccagcagcgtgtcaatcagctgccactgccggcgcggttctttgggcaagccaaaatgtaaccgcgccaatttgtaagacggcttgttataacgcaatgagccagcatcatcgtaaaccaaatcagcggtgatgatcgctcggcgattgtagtagcccatatcaccggtaatggttgcctcttgggtgagcgtcattttaagcgccggattcggattcagaatccgcacggcgtaaactttataatcaccgttatcgctattaaacagcaacttgatcacttgcagatcaacattttcataaacttgttcctgattagccatgtgcgcccctcctctcaaaaaacaatcaccgacaaaaactttatagttgcattcttagtttcgttgtctcgtgtgtcgcagccttgtcgagcttcggtgcaatccgaaagcgaaaatcctccggtacggcttgcaactcatgctgagcccactgttggataaaggtcggttgctgccgggcctgataaaactgcaactctgggcgatgcgtgctgtaaaccacgacatcttctcgcccgtgcttcactgaccactgaatggccgctagcagtgcgaccaagccggcagatggtagataaaattttcgcgccgggttgaaatcgtccggtgtcagctcagcatttgctggcgcatcagcgtatgccaactctttgactgcatcgtccaaaaactgggtgtggcgcaacaatgttttatctgccgcatctgtgattttcaagccaaatcgattgccattcaggtcattcagccacgctaaataaacctttgtctgcggcgcaaaatctgcactatcaacctcgtgttgcagattggccatgccgcgatgcagcatgatcccctcagctgtgcagccattaggaagtttaatgatgtgttgtgcctcgcttgatgttgcgtgtgtatctgccatgatcggcctcttttcttcaaataagcttaaccggtatggtggttggctgcaaatattgattagctaaccctcaaaaaggcggatgacttgctgctaacattgacttttgagtgatctcaaacgtcccattagcatcgacttttactactatcattcttttgatatttttggggttgaagcttagaccggcaatttaagtctcaaaaatcggcatttatttaccttaaaacgagacaaaaagttatttttagctttgtgatctcgtgaatttgaaagcgggtttccatgtaaagcctattaataagcgattaaacaaatttcgcttgctcactcaattcgtttttgttggctctcgcaaccattcgcgtacaattaaagttgttccagcgaatggaacgatttgacatcaattggggggaacttttatgtcaaagaaattgtggttgagcggtgtcgcgtttgccggtctcgttgtggggagtattgcaaccggttcatcgcttgtagctgcggacaataccgttggcacgacaaatacgacagtcgcagtgacgggtggcacaatcgaccttgcagtgcctgacacactgacttttccaagtgagcctgtcgaagggattgttagaggcaatgtcaacgagacggttaattccgctgacaactcattattaacgatcaatgacttccgcggtacggacgccgggtatacggtgtcggccaaagcgtctgcgatcacagccgctaatggcgatgttctgccaggcgcggccatcgaactaacgccagatgcaccagcagtgacgaatgctgataccccgacttggagtaaagcggtaacgttgacggattcagatcaaccattattcgccacgaccaaatcgctaaacggtgccggcattagcagttatgatctgaacaaaacaacgttggcaattcctgaggacaacgctgttaaggctgaaagctattccggtgtcatcacttttacattgacaccgggtcaaccagccgcaccagctactgcacagtaacggtggcgcgaggttgatggttttcgacttttctggatgtacttgccggaagggagttggttcatgtcaggacatcaccagaagactgttcggtcacaattaaaaatcagcgcgggtacccacgtcgcttggatcggcaatcattcacgcaccatatcgtattgaatccacaagtctttcatctctcttatgaattttcatctctacacatgcggcatcaccattgtcttgggggagacggtgatgccgcatgaaaaagaaccaaagttaatgtcttgctcaaggttgacttgcaactgtcagctttgataaccaagtcgcgacacggcaaccagcaacatcagagcgcaaacagaagcgctaaaaaatcggaacatgttcaaatcccaatttgatgttaccggcattgctgatcgttcacgcgcacggtcagcgatccaaacccacagtaccgatcttttcaaagttcccgaaatgggttgccgacttggtctatcaaaaagcatcaaagaaaccgtcgatttttgtgatcgacggttttttcgtgagcgctaaccagcccgggtagaaaccggagcatatgcggccttgggcgtgatggttggttttgggccattgcgatcaaggtccttatgcgcaggtttctgggctggcaagcgcgttatggcgaaacacaacgcaattttcacgaaatcagtggtgcgccatgtccaaatgaaccgggcaacaaaacctgcgccgaagcgaacttagccgcatgactcaatgattccgaaactttggcatccaatgttggcttgctcgaagaatacaaggtcgcagcaaaggacgtaatataagcatcccctgctcccaacgaatccaccgccttcacgccaagcgcctgctgccaagacatcatgccgtcaaccagcgccgccgaaccacgcaatccgcgtgaacaaacaatccgatcacaaccagctgccgcaacccggcgcatcaacgcctccacatcatcatcagagcgtgctttgccagaaagataggcgaggtcaatctgtggcgcaatctttttaaacagtttgtcatcgtcaaggatcgaaaagtcataaaccttgcgcgctgtgatagcctgcagaaaagcatccgcatgactttcactattcagatagaccagatcgaaactattgatataggcaatgtcctctgggtcaagtcgcagctcttgtggcggctcgccgaccactttacgccgtgccccgtctttgcctgtgatcgttgtaaaagcatttcgaccggcatattgaagcgaatgctgcacatctacgccgcgttcgaccaacatgcgccgcgcaaaatcgccacgcgcatcattcccgaacgtcccgatataggctgcctgcaagccgagttcggcagcaaaaaccgccgtattcgcagcatgaccgccaagatacatctgcttatcagccggataaaggtcaacgacattgtctccaatcgcaatgactttcaacgatctctccttctttccatcaaacgcagcaactgcagtcttcgatcaaactgccgtcatgcacacccctgcttcctgttaacaaggtcaagtttaccacagcaggaattaggtgtggcatcaagcttgtcatgttttccagaatgcatgatcatcaccaagcttatcagcgttaggaaatgaacaaaacggcgtccaaaactggccgtcgttttttcgttttatatgttattccaagctggtgtctgaaaacttattacggttaccaataacagtctaaaaatttcgatgatgggtattatcaccatcaggtttgctttttcatttcgccaaattcccaaccaccttaatcttcacccgattcgcattctcaggatgataagccagcggtacctcatcaacttcaacgacttcaatcgtcgtttcatccgcgccagattcaattgctgcggcagtagctttctcctttgcatcagccatcgccttgtcgcgcggaatctggttgtatggataaattcggccgtattcacccgaaacctgactgatagacgcaccaatcgcgtttgccacaccgcccaatgggtcacgaactagtttgccgaccccttccaaccgatgcggtgcaatgatcgccccgccaccaacaagaatcaccgttgctgggtcagcactcgttttcattttatcaatcgccacggcgatcatgtcgctgatcgtttgcaaagccgcctgagcgaacttcagcggaatctgcttggtcagttggggatcgccaacctcggacaaacccaaacgaaccgcaatgtcagtggcggtgataatgttaccgccaaacgtcaatgcctcgtcggtaatcttgtagccaacggaatcggggcccaccgtgacactgccatcttgctgctggcgaacgattgaaccaccgcctaagccaatcgacatgatgtccggcatccggaagttagtcgccacgccgccaacggaaacggcaatcgaggactcgcgcgggaacccagcttgcaacacccctaaatctgttgtcgtgccgccgatatccaccacaatggcattttttaaatgtgatagatacgccgcgccgcgaatactgttggtcgggccagagccaatcgtcaggatcggaaaatgtcgcgcataatccgcagtcattaaagtgccatcattttgggtcagatacaacgaagcatgtttaatgccagaagctgccaatgcctgctcgaaaccatcaactgtgttctcaatcacgcgaaacaagccagcattcaaaattgccgcattttcgcgttcaatcaagcccagcgagcccacttcatgcgacacggttaccggaaaatcggcgccatatgcggcatgcacaagctcggcagcggtttgttcctgatccacgcgcaaggcggcaaacacgccgataatcgcgattgaatctacctcaccgcgccactttgccaaaatgccgttgatttcatctggatcaagctcattcaaaacttgcccgtcgtactcatagccgcccttaacaatcgcatacttgccagacagcttcgcaaccaagtcttccggccaagctgtgtaaggaggaattgcttcggtggccggataagctagccgcaagacgccgacacgggcaatgtgcttgcgctcaacaatcgcattcgtgatctgggtcgtcccgagcatcgccttgctaatttgatcgagatctagcgcttgatcagccaaaaccgcctgaatggcgttactgataccggtctgaatatccttagtggtgtggcgcttcactgagttaatcacatgctgctggtcatccaaaataattgcgtctgtgttggtaccgccaacgtcaatgcctaatcgatacatggctagccctccttcactaagtcttcaaccggctgataatcataatcgaagccaaaataccgtggcccggcggttttaattccagcctctgtccgccaccgcgcatccgctggcgttgccaagaccttcacccgttttccgtacttgatgacttcagtcgtgaccggcaacaaagtatccgcatcaacaatctcgatcagatccggcgtcatgacaatcggcttgtcattacgtagcgccaacaggttttcgttttgaatcaggacactcaaatgctggtcctgaaaatcgttaaagccgtcaattttaatatcaccaacgttgaagcctctctcagttcggcgagccacatcgatgaccttgccttcaaaaatgagatgaccttttgtgacctcaagaatttcagtcagggctttagcgggatcgaggtgcgcatcgcgaatccgcaacccaacttgttcacacagtgttacaatccctcgaatgccgttttgcttgatctgcttaccgtttgaaggatacagcgccaccgtggcactgccgcccatttccaccgtctgcacccgcgccaagcgttcagcccacctggcactgatcgtcttgatgaccccagcattgcccttttcatcggtgatgaccattggtgtcgccgccacgccgcctaggtagaacgtcaccatctgcaactccggaaacgcgcgccccatgccgtcacaatccaccagcggaatccccaaagaggcagccagcgcaatcggtaccatcgaattcaccccgccagcttccatgggaaaagtgccgacgaattgatggccggtatactgactcaacattttgaaaacccgttcgaactcatcgcccttaggaatcttctccatcatcactgccggcgcgcccataatcgccgccggacaaaaatagtcatcgtcgcgaatctcgctaacatccagcaacttcacggggccatttttattgattgcttcaagtgccatcaacttacctaaaaatgggttgccgcctccgccagcaccgaaaaatgctgccccggtggcaatattttcaattgattcctgatctaataaacgcatagatatcctccgttatatgtcgttagtcgcgcgttatccgttcaattcagttcagacgctttgtcccactctggatgcaccttggcaccggcgtaatacagcacaaaggcaatgatgattcccaaaactggaatgttcggcacagccggcactaacaccggcagcacaccgaccaccgcacccagtgcccacgcggccaaaccaagccaattcaccccggcaaccggctgccacgcatgcaactgaccgtgatgaatcgcccaataagaagccgccatcgcaccagctaccggtggaatcatcgccgaaaaaattgtcatcaccggctcaaaataattcaaaatctcgacaatcgacaaaatggtgccgcccaagccgactaggaacagcgtcagtttgcgatacttctcaggaatattgaaaatatttgccaccgcaatcccgccagaataggcattgaccacgttcaccttccaagtcccaagaatcaacgccaaaccaccgatcaccggcgaaccaattttcataaacaaactgctgatatccgtcgacttgaacgcaatcgtcaaaatagcccccactgcgatcatcagcaccccagccggaatcaccccgaaaaccgccgctttgaccacatcggcgcgccttttggaaaactgcgcgtaatcaccgacaatcaccccagccatcgcaaacgagccgactgtcgaagagaagtcattcacaaacgacagcgtgccgctcggatgataagccgcaatcgtcgccgcagcatcctgcttggcaaacgcaaaccacaagccatacagaatcacgatgatcaagtaaggcaccgcgacatacgccaacaaacggatcagcttcacgccatacatcgcggtcacaaccatcagcagccccgtcaacaacgacgccagccacgccggaatcggcagtccaagatacgtcagcaagttggcgaccgccaatccaccgacattcgcctgaatcccaaaccagcccaacgctgcaatcgcaatgatgatcgaaatcaccttcgacgaccccgccttgccaaacacctgttgcgccacgacaacagccggcttgccttgatcaacactctgcatcccctgcgacaccatcatcaacacgatgaaactgtacccagccaagccagtcaaaattgccaccggcagtgacatccccgccaccaaactcccgccaagaatcaagctaggaatcgacaccaaggcaccacacaaaatcatggctaacccaaaccacgtctgatcacgtttgttttcttccatatcggctacctcacatatatttttaataattgcgtgcatttcgactaacatctaagtttgaaatcgattgccagttggaatgtaatagcctgattataaatttatgagagttcgcgtcaatatgttcattcaaattttataatgtatttttgaaaaactgtcgcgtttattttcaagacgaattgtcaactcaagtgcaactttttacccatgaagacttctgatggcgtcttccagcctaagaccttgcgtggtcgattattcagttgttcaatgtaagtctcaatttcctggtcgctctgaaggtctaggtctgtgttcttgggaaagtattctctaatcagtccgttggtgttttcgttagttcctcgttgttgaggcgcgtgtgggtcaggaaagaagacctttgtattcaggcgttctgccagctccctgtaccgggcaaactcccttccacggtcaggagtcactgttcttactcggttagctggtaaggcaccaagcagcacaatcatgacgtctctaacagtgtcagcttttgcgttggccgttcgcttcgaaagcagatagcgtgatttacggtcaactaatgttactaatgcagagtgtcctgttttaccgcgtactgtatcgccttcccagtgaccaaaccagctgcgattttctgccgaccggggtcggtcgtgaattgatggcacgtcattgaagcgcccccggcgttcatttatggtgcctttgattttgcgcgtcttgcctcggtgtcgaagcagccttggtagcccgcgagcaccatggctcttcaatggaacgccgagattatctaggtagatacctctgtagatagtcgaatagctgatgcgaataggactgccttctagtgacaagcgaccggcaatctgctcaggcgaccaatgtagcaccgtgatatatcgaatgacagcgtcacgagtccccggtcgatcgaggatccgaggacgcctgctagccaagcgaacccgccggtagcggtcctgagcggtggctgccgaatagctccgccagccgccgttacgtgcaatttcacggctgactgtactcttggaacgacctatctctttggcgatggtatcaagagttttgcctgtagagataccaagcagtatcgattcacggtcttttaaggtaagatgggtgtacggactcatagtcgagttctccttgtagttggtcttgtggtgattccattttacaaggactcaggcgatgagtcttttctatttgactagtttgttgcacttgaattgtaaatccgtcaaattaaaaaagcgccgacccatgccgatgaccgaatgaagcagtcgatcgaaatgagtcgtcgctttttaaaagataagaattaaagggctaaatgccattgtgcttgtagcgttaagcgctacatcagtcgtcatagacatgtgcgacgttgaagccgccgatacattcagaccatgcacgcgcttttcagcccaatatttgccgaattgccagtaacaccaaaccaaatcccatcatcgccatcgtgatgttcagcaccttcgtcacgattcgccgctcttggtcatccatctcctctatcatgctcaaactatagtcattgtaaggaccagcatcccagtacccggcataataactcagcaacttcttctcacgaccagtcaacggcttactgtcagcgcgaagcaacagttgatcatcaaacaaagcatacatatcatcgctcaacatagcggtcttacgatgccgcctcacctgctcactgatccgatcaaacaaccgctgaaaccgttcccgcgcctgcgcatcttcatcatcctccgctgaccacgccgtcaatttccgcttaaaaatcgccatcaccgcgttaaagtgcttccattgaaaatgatttgcaaacgtcagataacgattctgttcattcagatatttattttgccaagtctgataaagaaagtagccaaacaaccacaacacgatcaaagcattgatcaagttccccaagttccaagccgtcagcaatttctcaagactgccaatcacccaaaaagtcaggatcatgagactaacaaacaacgacaacagctgtttctgccgcatctgcggattccgctgcatctcgtcatagatcgtctggcgatgttttaggtaaaggacaaagtaatccaaaaagtccaacgagcggacttgtcggtaagtcttaacaatgtaaaagagcaggatgaccagtgaaaccatgttgatgacgcggttgatggtgtcgattggggacattgaggactccttttcaatttaatttcaatgttgtagtgccatcatctttaaacccagttgctctttatagtcacaatacggacctccggcgaatccaatttataaccaactgtcagctaactgacggtgctgtgtctaactgctaacaaacgacaagcaatctcttcaattctgcgtttattaacttcctagctcacacccaaggccttaaaagccgcatctttaaccgaattataaaagatcaagttaaatgaactcatcagatctgttggcacaccgctgatgtcgctggccgctgcagctggcagcaagacacgttttgctccaccgtccaaggcgacttgcaatgtatcggcaagatcatcgatgcgtgaaatcgttccgccaatcgtgaaatcacccaagataactaaacgatctagtgtcggtttccctaatgcgatcgaaactagcgcgataaatgtcgccaaagaaatatggctagatggaactgaattattcaaattagtcgcgctaaccacgaaatcacgggcgttggcattaattcgttgatcaattcctttatagttggcctcaagatacttaaaggctgtgtccattgcctctttagcttttgtacttgatccgacgcccgatttactcagtctaccaagtcctggaacgacctgtgtttctaatttgatcagactaagccgtttactctcgtcataagcaacagtataaacatggccgggattttcttgaccatcaggaatgagcgaacttgatccagtttccggaaccgagacataagtttcctcaaaggtcgtcttatcaatataagaaaagttgacatcatagaattccatgcccccgattcgtttgagttgttcttttactcgacgacgcatttccatagcaaattcaagaattttcgcaacgtctgctttttcaaacacaccgtctggataaagtaatttgataagcccagaaacagtcttacgaaccgcaatcacgtcacgctggttaagctgtttaccaaacgaaaaatactcgtcaatcgcatctgcataagaaattttacggagctcgcgcattacctctgcaaaataatcagtgataaatccaaatcctttggtaaagaactcaggccgatacttagggatctcccaaccaggtaagtagttatgaattctatccaagaaagccgtatcattgcccatcatctcaggaaaaggttcaaagagattggaagttctcaaaaggacatcaacactctgattgatattcccgacaaacaccattcctgctgaagcttgaatctcatttcgcccacgtgcaaatgatcccgaagccatataatccttcataatctgcacgccatctttatctttgaaatgaattccagccacttcatcgaatgccacgacatcccacatgccaacaagtcccacttcacgtctagacatgttatagaacaagttggcgaccgttgtctggccacctgaaatcagaattgagtccggcgagagctccttataaacatgtgatttgcctgtgccacgagggcctaattcgacaaaattgtaattattttcaacaaaggggattaatcgagaaagtaacaaccacttttcgcgctcagtaaattgagttggctccatccctgttgttcgcaataaaacatccagccactcttcagtggtgaatgcctttcttccggcgtagacttcttgcatatcaacaaatggtacttgaataggattcagtttttgaattgagaaatggtcaaggctttcgtgatcgtaactaacgcgcacaattgaccaaatacctccaatcaacaaacgctcataatcttgcacataatgctcgtcaaccggcacgcccgttaagccaagattgctgaagctcgcttcataccgatcttcaccttcattcaaacgaactgaaagcttgtcgatgactgtataagcaccatcttctcgaatcttagattttactttttcagcctcatcaggtcggacataattatgcgccaacgtttttttgacattctcaacgccgcgctcaatcgtctccgtatccgaactattcgcaaactgccccaataaaaactcaagaacataagttggcacatttgcgccttccttgattctttgcgttagatcttttcggacaaaacgtccaggaaagttttgttccaacttgattaaagttgcttcattttcagaagtttcctcgtgcgcgctatcagatgtcaaagtcaaaacctccccccacagtgagatccatttgataatcaatcagggtgctcgtattagcctcaacgtttttgatgactaactgatattgacccccacgttcaaagtcctgatcaatcaacggtatgtgtcgacgaatcaatcggtcattgacattgattgaggtaatatccgcgtgaacaagctgttcgccagaaatttgtcggccattcccatcaacaaaataaagcgcgtaagttgctgcacgatgagtttcatccaccggatcgttttgaaccatattgacaataacctcatggctcgtaattcgccggctagaatctgtcactgccaatgtagcatacgtggcctgtgacttgcgactctctgtggtgacatgcaaaaccggaataatcatttcttgaggagaacacccgccatgaacataattttgaccggctccaggtaccgagaacacgttcgcattacttggataaaagacgaaccgctgatcatcgttgcccaagatatcgcccagcttgacgttatctaccccaatttcatcaaaatcagttgatccaattgcgtaacggagattcttttgctcaaagtcgacatcactcggtagattaatcttatctgttgaatccagtagatgccggcgatagataaagccatggtcagctgtcacataaatatttcgaattgaaatagtccgcaaacgatcaacgccccgctctaactcagctatcgcatcctctacggcacgaaatacattgacttccgaagctggcttatcgccagtcgcatcaacggtgttgtgataaaaataaatcactttttgatcgacgacgtattttttctgctctgttgacgaaagtgataagaaatccgtcaaccgcatggcttggctttgcggctcaatcgtttgtaggatatgcatgcgttgctcaagattgatcgccttttgaccatccaccaataattccttgttgccttgatacgcgagttcatgattcggcaaaagcgatggcataccaaaataagtgacagacggcaatcccgtgactgcatattgcatttctgtgccaaaaacatcccgtttgtccagtctttgctgcaattccttagccgcctcaaaccgaaaggcatccgaaataatcactactgtacgatccttatttggccccaccgtggaggagtaaaaattccgctcacgtctttgcggttcgatcatatttggcacataatcttggcaccaatcagagatcatcggaacaagatgctcattgttgtacgccgattcaacatttcgggacaaattgtcaaacaagtcgacctgtgtggctggaagctgatccagagcattgatatatcgacgataagccgtgtcaactaaatagtcctcggtgatataggcctggattaggtcgtcaaactgatcaacatttcggttttcccgaggcaacaaaacgttatgggcatcaacagtcatattataagcgagctgatactccggagaaaagtacattttcccacgtttttcagcaatcgctggcaaagtcatgtggttaataacctctcccagatgccctgccaacaattcagaaatcagccacttcacagcgtgccgatcgaactcaataaacgtgtctgccttcaataaatcagctatcttcaagttcttgaagatttgcgttccgtcaagttgacgccagactttagcagctgcttgtttatatacttcgcgagtatcgttgcgattccgccaattcaacatgaaagacacaacattattaatgtaactgacttcataatggcgaagcattaccggcaaatccaactccatctgataatacgcaaaattcaccatcatggttgccagcagctcttgtaaatcatgtttaccatgatagccatatgctcgatcaacaaaactccaaaatgtctctaaaacctgatatttggcaaattcatctaaaagtgttggtgccttgataacttcgatcaatatgtttgatagttgtaagtcattcgtcttagcaattgccgcaagctcaacttgttctggattttttccgcgttgataacgctgcttaaacttggcaatacgcgtcttagcggcaaagaattttcgctggccttggacaaaggtcaattcagtctcaggcaatccaagttcgtgaagcaacatgacattcatatcggctgtaaactttttagaataaagaatcatgtcggtcaaaagattctgatgaatgtctggctcactgaacgcagcataaacaagcgcctttcccccggccttttcaatgtccaaaagttcgattttcgtcttcagctgggttcgtggctgcatgattacaatcggttcagtcaactgatgacctagttcgtcaatattgtcagcaaactcgccttccttgtcataccaaaagacaaagtgcgtgtgacctttgaacagcttctcaatgccagtgacgacatccttcaattctacctctgccatactttatctactcctacttagcgtcccagttagtatcctagcttccagtataaccaacggataaagccgtggctataatcctattcttcttttgttcactccaagctattcttcgggtgtcattaaggacttggttgatgacattaaggaagatgattttgatgtagacaagggtgggcaggtcgagattattgggtggttgtatcagtattacaatacggaaccgaaagatgtagcagtggcatctcccaaatcccacaaatttcgagcgccagaaatcgcatcagcaacacaaatattcacgcctgactggatcgttaagtacatggttcaaaactctttagggaaatactgggttcaagttttgcgagctcgtggggatgatcgaactgaacatcaaatcgtcgattcttatggctggcaatactatatggttgatgcagaccagtctgatgaagcaaggttggaaattaaaagtcttaatgtcagcctcgaaaaagcaaaaattcaagacattcagtttttagaccctgctatgggatcaggtcatattttagtttatgcctatgaactactcatggatatttacaaatcagaggggttctcgcagagagaagccgccttatcaatcattcagaataacctttatggtatggacattgatgaacgggcatttcaactcgcatactttgccgttatgatgtgtttcagaaaatataatcgccgtgctctggaacaaggcgtgaccactaaacttcacttttttaatttagttttgccaactgccggtcaattagacttggttaaaaacaccggatctattaacactttcaaagtcttaaaatctgttgtcaactcttttcaacacgcaacggaaaccgggtcgctcactcgtcttgatcaacaacaaagaacggcattaaaacaagttcttgatgacctttccaataaagaagtgccgatgtatttgcacggtttgattcagtctttgaaaaaagttcagcaaatagcgaacattctagaatcaaggtgggatgttattgtcactaatccgccatacatgggatctgcacgaatgaataagtatctatccaactatgttgacaaagcttatcgagaaggaaaatcagaccttttctctgcatttatggagcgcttttataaccaagttaagccagagggctactgtgcaatggtcactatgcaatcttggatgtttttaaagagtttcgaaacactccgtataaaatttttaaatcaacataccatatcaaatttgatgcatatggagaatggcgtgatggggattgcttttggaactgctgttactgtagccagaggcaaaagaatcggtaactttgtggggacttatcaccagataaagacgcaagatgcagttaacaaagtaccaagcgtccttccgatcgctggaaatagatttaatcgtactaaacaaacgaactttgagaagattccggggagtcctttatgttattggatttcagatcgagttttaaaagttttctcgctgcctaagaaaatcaatgaactaggattctctaaaaaaggtcttgacacaggtgaaaatacgaagttttacagactatggtttgaagtaaataatgaagcagattattggattccccttaataaaggaggcaagtttcgcaaatggtatgggaaccacgaatacgttataaattggagtcagaatggatcagctatcaaaagaaatggaaaggcaaatattaggaacgaaaaattctattttaaaccctctgtctcttggtctgacgttacttctggaaaactgtctgctcgattaacaccttctggctttatctttgatgcaactggaccatcttattttggggccaatctcttttcgatgttagcctatatgaattcaaaagtgttcgcttctatagcagctttaatgatgcctacaattcatttcacaaatggacaagttgggctgataccatacaacacacaggccgattcaaatcaaaggattgttttcctttcaaaagcaaacgttttgatttcaaaaacagaatgaaacaattttgaacaatcttggaaatttgactatcatccctacatgtttcatatcgctgatcatcagaaatcacctcccacaaaactcttgatcttttttgacttttgtgacaaatatgtgccaattcagtttagggggttgattttttatggtaagttatcaaaaaagaggtaaagtatggcaatacgagatttcgtataaggatctggatgggaagtttaaaaagcttcgcaagtcaggattcccgcgtaagtcagacgctgaattagcggctagtcaggtgaagtcgatctatcttgacattaaacagtatcaggctggggcgatcactttgtccgaatactttgaccgctggattcacctgtataaacaaaactctgtttcatcagttaccttcatcaaatatgaaaacaccttaagtcacattcagcaattgtttggcggtgtactcttgcgtgacctgacacggacgctgtatcaagaacgtctgaatgtctttgcgcagaaccatgctccaagaacagtggcagctttccacaagcggattcgtgcagctctactagatgcagtggatgaacgtatcattcatcttgatccaacacgcaaagccatcatttcgggtcgttcactccccttaactaagcgtgctctcgattatcaagaatggtctcgtcttgttcgtgggttagataccttgaacacagaacaaatgattatttacatagccgctgtcacgggacttagatatgcggaagttctgggtctgacagaacgtgatattgactttggtcatgcggagatttctgtgaataaaacttgggattataagtatcacactggtttcaaaaagacgaagaatactgcttcagttagaacaattgtactggatcctgtctctctttctagattgcaacagtttttaaaagtaaatcgtcctcagacaacgaatacggcaatatttgcgcaagatggacatgcacccgtcagtgcggagatcaataaggttttgacgcaaaagttggaatcacttggccttccgcgaattaatttccatggactgcggcatactcatgcatcgatttttctttatcaaggcgtcagcgtcctatccgtttccaagcgtttaggccatagcaacattacaacgacacaagccacttatctgcatgttatcaaggagttagaaacacaagataacgagaaaatcctatcaattttaaaggcgatttaattggcacatttcttggcacaaaaaggcgatcctcaactgggatcgcctttttgatcactttaatggtgtcaaaatttttgtatcagcttgtgctttggcatgattgaccagaacaccatcatctaaatcaagatcaatatgcaggtttgcaacgtgttgtaacttttcatcgtacttaatcaattcgtccaattctttggtaatcgtggtgatccgcttcttatatttatttttttgacgggtctgctgctcgtcttcttctaattttttttgctgtacaagcttgcgctcataagcttcttgaaggggatgcaagtatttagtccgaatcatcgcgacagtgttccgatcataacgatgcaaatacattagcgccttaaagccgccatttcgtcctgaattgaattcccaatatattggtcgcttctgataagttgatagatgatctttcttgaaaaaatcatcacgaagataagcccgaatcttttcttcagaactttctccccgtttacctaaagcatcagcaatgaatttcaagttctcattcaaattttccgaaccgaaactagtcgtcaagaactccttaaagcgattcatgacatcccggtcatcaccaaagtaatcgtcatcagttagcagaatcacatcgtcctcgtttgggatgaaagtcttatatttactggcatcccaatctcccccagcataagcaagtccaggtgtgtcaattgagtatcggccaaagacgcaaccaataaagtacgacataaaagcttttatatcgcgaggcaagcaagcgcgtctaacagatacgtctttatcttcctcctcgggactaagctcgtcttgtaggccatacaaatcaataaagattcgatttagttcctcttcattggccttcaactggttaaaacgatcatccgcctctttctgccattgtttaaaagcaccctcgacagtccaatttcgatgatgatcagcaatattgtccaataagggaattttttggaagctccaagagttttcatatgaattccagtctttttcagtattggcaaggcattgatttgctagatcaaaagcagctgtattctccgtaaaaattattggtgtcaggctaacataaccgatgcttgcatgtatagttggatttaaaaaactcataatataattcattacttttgtattagaaaatagtaggatttgtaagagccttttggtatcagacgagaataaggacattccaacaacgtcgaaaattgagccttcttttctataacgcatactgaaatgcccactagttacatcagaccatgttatcgcctcacgaaagtaataatccgtgttttgaggacgcgatcggactttaccattaaaatcaacaaagtgttttatttcgtatccatcatcctgccaattaacaacataatcatagttgccataccatttgcgatatgatccgcctttattataaggaaaccacttttcccccgattttaaggcgtcctctgtgcttgtagaggtgaaactaatccgaaatggctcaacttcgtaccattgacgaagaaatctgttattatcgccggtttgtaatcccactttgggctgtacaagatctttcagaggcgtcccgatctcaaagctccggatcaagttgttacttgcccagtatgcaattggactccctggaatcttctcaaagttcgtttgtttagtacgatacagataactcactgaaggatcagcaacagctttcagcacataccttctttgcacttccatgccgcccttgaaatctgaaagttttaaataagtaccagttgaatccgcactcatatcattctttaaaacaaaagtgtttattggaacagtggcctcctcaaatgctgagtattccatctgaattaaactagagatttgtttagagtccaaaattgacttacgcaatccttcataagttttgataaacatccaaacgaatggcgtcatgtaagcagaatatccatcttgcttggtcatctcaatgttcttccagataaacaccgagaagagatcacctgaataagctttatagtattttttgacgtactttttaagatcgccattcattcgattcaaataaggcggatttgtcgcgacaacatcaaaatgagtctgaagaacttgagcaatcttcagaatgccgagaagggagttcttcgccgcttgaaggccaaataagtccaactgagttgaatctggtaatgaattaacagcgctgaataatgcatcaaaatcaaacttcttttcaaaatgcataattgatccgagcaactttgcttgcttgaaaattgacaccagcgtgtgtaagtcaccaagggtatctttggatgcattcattttttcaaacacttcatttggcacatcaacagttgattcaaacacatgaagattgtgtcgaactggtttgcttaagattcgccgattgtattggcgcgccttcatcattagtgcaaaataagcaagttgataggcgcgtttatcgatctctagtccatacaagttgtgtgccaaaatcgcatctgtcgcatctcgtttgccgtaaccttgttcttcatacatttgaattaacaagtcgaatgcgtaaaccagaatgtggccagaacccatggcgtcatctaacactttgagctttgaaagatcaaatgaatccgtgcgtgtctcaattgggccaggcagaagataggtcagattcgccttgattggcgaatcagggaagtactccagatataatcgacccagcgagttatcaaccatatagcgtacaacccagtccgttgtaaacagctgtgttgccgcaggtatgtcattagtcttgattgggccgccattaatattgacaactttgtcatgtggctcaatattgtaatactgatacaaccacccaataatctcgacctgcccgcccttatccacatcaaaatcatcttccttaatgtcatcaaccaagtccttaatgacacccgaagaatagcttggagtgaacaataattgcatgaaatcgtcagttttctcaaaaagctcagggagatagtgatttagtgcatttgcttgcttagtaaagagaataacgtaggctgcatccatatcagttggatcctcagtatcaagtgctttttgaataatttcatgttcatcaacactatacccaccaagatcatcttcaatttcaaaagcctctcgcaagatgtctggcacctttagctttgtttccgacgacaaaacccgtacgccactcggaagatattcgttaacttccataaagcgaattgcaataatccggttaaaccatgtgtaggcaacttcttcgatcaaatctgttaatgcatctgaccactcttcttgttttgccatgcctttaagtcgggcaactagttcacgacgtcggcgaatatcctggcccgttattgacaatcctttgtcaccgtaatattcaatttcgtttgtggactgagacattttctcagcaacgccgtccttggtaatcccgagattttcaagtttcaatttaatgctttcaatcaaactgcggcgagcctgaatcgcaaatgttttgatagcttttttatccatgagtacccctttcaaagccgacacacgtgattcagtcgacctgcaatgtcacgattgtattgtctgacagttgtgcttctagcaatcttttaaactcggcagtcagctcagccacatccgcggaatcctccaacttgtaatcaccacgacgaagaacctgatcaagcttaataaacttctcttcctttgcccttggtattggctctggctctggatctggacccggatctggtatcggtggattagtcttatcatggtcatctggagaaactggctcaacgagtttaacttctcgttcgatttctttctggatgccatcacttagttgatccaactgagcatgtgcctgcgcaggctttgcaacgacttcgtttaaagttactgcgttctgagcagcattacgaatgattttgatcttattttcaaaatcacgctttaaccggtctttcgtttcttcattagaaatacccgactccaaaattcgtttaatgccacgatccttgagttcgtcgatttgtgctaaatattcagctgccttcttatcaaaagccgcagtaaataaagtatcaaagtcattgtttaattcgctgattttgactgccgtgtctccctgaagtttctgcaatcggagaagtttacccatctcttcaacgatattttgcaatttgctatcactcagaaaatcacttgagtcgcgataaaccctcaatgcatttaatcccttatcccaaattttttgcattgaaacactaaagtagaaatcacgaataccatcgtcaagaaaatcgtcgttccaatccaacaaatcatctttatgtttgccgatgtaatcataaaacgcaccagaatcgggcatattcaaaagttgttgcaacatttgaatgccttgctgtaacacaacgtgacccggatacccctgcggttttgcctcaaaatctaccaaattttctaaattgtcttcgacagtatccttaagttcagaagcccgctgttcatcgttatcggacttaaacgacttcttgccaaacactgcagacgcgaccgtttgcatagctttaatctttgatggggcaacttcttctttaatttggaaagctaggttcctcatcgcctgctttttagtaaagaaaccagctaggtcttgcgtcgtatgtttatcgtccatcgggttaatagaacttccattgtaaaacatctttaacttgccaatagcgactaacttcgcaacaagccattgaatgtcctcgtcagtataaccgtatggtatatcgttaaacttcgacaggacactttccatcgtgatatgcgcattgttttgagactcacgacgcatgtagtccagaacagcatctacggctgcttgattgtctttttcatcaagcgccaaactcgagatattttcaaaaagttctcgaatatccttttcagactttgcaaccgtgatatattgcaaacttcgataggtattgtcgaccagcagcttcattgccttctctaatcgactatcaaagcctgcttcactactaacagattggccattttcataaatttctgcgttatccaatgcagcaatcagctgttcatgggcatgagcaaactcctcattttgctgagcttgtcgtgttgaaaccatcgcttgatagcgtggatcagtggaaacattgctgttgacaacgaattttcgaatgcgcaaagcgtttcgaatttcaccgacaaagtttgatgaccgcggcaaggctatcaagacatcgtgattccataaaccagtcgatactcgtagataatcgttatcttcaagaaagtcgtcgttgactggtgtgatgatgtgcactgacaacttattacgttgcgcaccgaagatattgtcagttttccgattaaaggcaaagacatagcgaccattaagcttcgggtaagtcaaggttgtggcaacacccggcttagcattaaataaatagtcgccaatctctttagcaacttcattatccgttacttcctgctttgaaatttcacgggtaatatcttgttctgcgtctgttaaaaagtcataccctttaacagttttctcaacgtagccttgcgttactaaaacatctaacgcatcctgaacctgctttttaagcgcaatgcgatcagcatcgactgaactaatcatcagagtaattaaattatttaatgatgctgtgaagttagaaacgtatttaaccatgaataatactttgagtagttgcagagcaaatggattcttttccttattcggattaacagcaggattatcgtgtgcgcgaactaacacaatatgatgtgtgtgatccaaaaactggtccaacccgtcaaagaatcggctaaatggtgctaaagtctcagtgctctcactcatcatagcctccgcagactcttggaaaagcgaaagcatggagcgttctccttcagacaagtgcttgccatccgatccgttttcgcgaatcgccgttaacaccaactgtaagagattaaattgatagggaacaaatggatagttttgggcgaaatctttcggcgattcatactttggacgtttaacatcatcatcgaaatcaaatgagttgttaatagcagcagcgttcgccgaatattgatcttcaagcattttttccgccacgtctgttttttctagtaaacgtttgcgaataacttcatcaacattagccgaactcatcgacaggcgtgtcttgaaacggccttgaatcttggagaaatcctgtcctgaggcaatgtccgttactttgtcaattgcttgttgggatgtgacaacaacccatgccttgccacgtgtcattgtccctaactgctcaacaattgtttgcagattaagcatgcgttgaacgctatcgccaatgaactgaccaacctcatcagccagaaagacgacacgatggccggttttatcaatgtactgcttaactaactcagcaaaatcatcaatgctgatttgatattctgtgctcaatgtatcaataaagccttgcgcatttgcttcgtctgagaaaccagaattaatcattgctgctttaatggtgcccttgttaaggtaataggcatctcgcaagtcttcccaagatttatgattagcatcaatcgcggtaatttgttccttaaaagcatctaacttaccagcttctgtcagctggcgttcaaggtcagcaatccaaaaatcggcatcagtaaatccttgcatttcattgaaaacacgcataaacactttcaagatgctttgtttatctgaaccaacggtatctttggcttttgcatcaatgttaaataaaatgacatcattctttgcagaagctgccgcgtgcatctcgttgagaatcatttggtcatcaatcttgtcatcgaagtaatcgacggcatttttaccatcaacaaccttgttggcaagaatatatgaaataatcttcaagaagtgagatttcccagaaccaaagaaaccagaaatccagacacccatgtcatccgttggcgtctgaagactattatcaaatgcattgaaaaaggccgaaaaatgatctcttagttcactggttacgacatattcgtccaactcttgctttacatttgcttcatcatcttgatcaaccttgataacaccttggatgttacgatcaattggtcgtttaaaaagctctttaatttccattccccaaactcctcctattcaactcgaaatgcacggtagtagttcttgtcatctaatttaccaaacgcgcgaagagacaaactgttataactgcctggataaaacatcacaacaggcgtttggttaatcacttggttcatcgtgttcaagacgcgatgtgcacgaatcaacggaaatatctgaccaacaccagtgagaaaaataatattgcgctcatctcgatgttccagatgatccaatatgtactgaacgatcaagttgcgttctttacccatttttaagacgttattgatttgcctaatcaccatatcaataccgtctttttcttcaatttgaatgaactcttgcagataacccatttcatcaatcagtcgaataacgacatcgaacagattaaacatctggacatttgcgccaattgaagcagtggtcgagttgtgcgcaatatcttcgacctcattacgaacgaataactcatcttttggatcgtaatcgaaaatatagaacccgacttcattcgagagccctcgattttcctgaaaagcaggatttcgtatttttttccgaaaccggtcaaagcgttcacttactaatgtcataatgctctccccgttagtgccaaaatataatcagacttcccattctgttcaagccatgcgaccaatgaagcctccagtaaagctcgttttaattgcattgcacctccggcatcttcagccaagccactttgcgttaggatttcgtgaaatctagtctgaatttttttcaaagtttgctgcgtccaatgagccgtttctggatgttgcagtggtaaatcttgcaagtaagcactaatctcatacggttcaagtttcaaatcaccagtcaaaaattcttttttcacaacttctaaaacaaagtcttctaccagaggatgtgcattcatgatcgcaattagattcattaacttctgattattgaggggtaactgctcaaaaagctcagaaaaacttgctggtagagctgaaattcgaaacatcaattctctttttaactcagtagaccgatttgttgaagacatcttgaagatgttgtcgtcaatgatggcttctgcaatgtcatcccaatccttgccattgttcagcattgagatcactgcagaaaattcaggaaaccagaaggtacgagaaataaaggttgccgaaaatttcttcaagttgatctcctttctaagtttatttgttcaaaagtcaacagggtcttctcactacaaaatactccttttcattgtatcaggatactaacatgattggggcaactttctggacttattagcccttcgaaacacttgaattcattacaactcaagtgattcttaagctgcacgcgattcaaaccaaatcgtttcacagataagggtaaataacctacctacccagctgcgggcaactgcattatattcgctatcattgtgtatatatgcccaccacccaaatgtgctaaagtaagactctagacaccatcacatagaaacatctttggagtgagcaaacattggctaaagaaacacatcacgtcgtcatccccgacgccatcatggaagatcttgatattaaagatggcgagcaagttgaagttactttaaaagataaggaagccgtgattcggcctaagcggacggacacggggacgcagacgatttcgctacggttcttcctgattccaacggttttggctgggatcgcgtttttggcctactttatctattttcagattttgcaggtgccgatgacggggaagaactcgatcgctcagatggtcattgtgctgggcgaattgagtgggattgctacgtttgcagtggcttacattcagaatcatcgccagattcatgggcgggatcatcggcgccggtactggcgaattttcccaacgatgctgttgtcctttgcaattattctcgcgtttgtgacatcagtgtttttctgggtgattggctatatgtttgaaggcgtcagttttgatatttatacggcgactgggttattcctgttgtttatcagtattgtgaactacctgatgatttattcggccttgtcgatttcgacctccttcatcacgaccctgtttctatcgaccttcgttggcggtgtcattggcgcgattgtgacgaacagttcgcgccagtggtggcaacataacgtcagttttcttggcacgaacaaggctttgaatgcgtggcaatttaatctcaccatcgctgtgtcggccttgctgtggatcgcgctggtggattatctcttcgtaccactgatggcgcatcgaaaaaatgattggcggttgatcacgatgcggatcatgttgacggttgcggcgattgccttgctgggcgtcggccttttcccgaacaatcgcggcctcatgcatattttgcatacacaaagtgcttggttcctgaattatttcatcatcggcatgatcattgcggttcgctggctgttgccaggcgtttcgcgcgaatttctgagcaccagttacatcatcggcggcatcatcatcttcgctgcgatcctcttccaattcgtccactacttgtcactgacagcgtttgagatgatcgccttcgcactcgcgatgtcatggatcatgttgttgctgcagaacattcaccggctttaccaaaaagacgagtctacgtttgttgtgacggtgaccacagataaggttaatgctgactaactatgatcaactgcagtttcttggcacactcccagttagcgtcgtgataactcattaagattatcacgatatcgactgctaaccagttccacaaaaatgcccctagtatcaacagacgattgagacatctgctagtacgagggacatttttgtgctaaacaagctgggagatagttttcagtcacccaagtaaagaccaacaatttgcctattaccaagaaacctttgtcttaatcctcatagaagatttatgacgacttttaaagatcccagtgccaaagcggagcaatcgtaggccagatggggctcagccgtgcaaacaacacagcgacggtctgtggagctgatgttgttaggcgacttcgagaccgcgggccttgcgggctcgaagcgccgtcacagcgttccagccccatctggccggagattgcggagtttggcacgacatagaactttttgcctagagattttcctcagataattcagaatcgtggagcaatctgagatgttttaaatcaaaacgtacctaactcggctctttattaacatcaagccggttcaaccgattcaaccttcacatcttcacgctgcaccgcgagcaaatccgccccagcctgaaccgtggtatcagccgccactggctcgatccgtgcataagacttgctgttggtaatcagcacgatagtagtcgcgtctagcccagcttttttaatagctgcttgatcaaatgtgccgagcaagtcgcctttgttgacatgctggccggctttgacggcgactgtgaatggtgcacctttgagattgacggtatcgatacctaggtgaacgagtatttccatgccatcatctgtcgttagaccgtatgcgtggccggtgtcagcgacgacggataaggtgccagcttgtggtgcgtaaactttgttgatgccgggttcggcaggcttgatggccatgccttcacccatcatccctgaagcgaaaacgggatcgctgacttgatccaacgcaactgtttcaccgccaacgggtgcatagactttgttgtcgctgacggttgaggagatcacagcattggcggtttcgacatccccgtctggcgttagcacttccttcgggatcgcaaacgcgttagtcgcaacaaaggccgcgacaacggtcccaagtgacacgatggtataccataacagcgcgtggccgttataaatgtacatcagataagatggcaccactgcaaggccatacgagttggcagcaacgttgagcatgcttaaaatcgcagcgccaatcccggatgtcaaaacggtgacgatcaatggccgaaagttgtagcggattaagaccccaaacaatgttggttcggaaaccccgaatagttgtgaggtaaaggcacccattgaagttgctttagccttgttggaacgagcccgtaagaaaatggcaagggcaacgccgaggttggcaaagccatacatcgcttcaagtgtgatcaacggattcaagccggttgacgcgagcagcgaagtttcaatggcgatcatggtctgatgaatcccgatgagaaccatcagtggataagcagccccgatcaggaacccaccgattccgaatggcagatggatcacggcttcaacaccgacaagcatgccactttcaatggcgtggacaattggaccgacgcccatgatcatgatggcgaacgtgacgagcatcgtcaaaaatggcgtgagaatctgttccaaaacgttgggcatgtgacgccggaagaatagttcaagtttggcaccgataaacccagcgaccaaggcggttaacacggagccttgactaccaacaactggcaaccagccaaacagcataatggccttggcactgccatcagcaaccgaatacgcatttggcaaaattggcgaaaccagcattaaaccaatgacgatcccaatgatcggtgtgcctttgaagtagcggaaggtcgaccagacgatcaaggcgggcaagaaagcaaaaacggtatcggtgagcaccgagattaccgatgtcaggctagccggtatatcgcttgggaccgctccgaaaagttttaatacttgcgcattggttgctgcacttttcaaccctaagaacagaccggtggcagcaatcacaggaataattggaatgaaaatgcctgacagcatcgccattaatcgttgtacgactgtcttgtgctcgttgctggttttaccggcagtgtcggcgtcgtctttaccataaatcgcattcacggtgccaagcttagcaatggccgcgtagacatcgttgacaacgccggtgccgataatgacctgatattggccagagccatagaaaacgcctttgacttccggcaacttctcaagggctttgtcatcaattgccttccgatctttcaccacaaaacgcaatcgcgtctggcaatgggtcacggaatcgacgttattttcaccaaccagctttaaaattgcttttgcttcttcttcatagtttttagccatgatcatttcacctcaataagaatcgcttgatagggttgtaagctcgttccaacgtccgggtaattgttcagccaaacgtgaccagctggtaagtcaactgcagctgacttcgagctaagattcacaaaaatttggacatgttgcccgcgggcataggcaatcacgttgtcgttgtgtgcatccagcggggcaaagtcgccttcgatcaaatcggcgcgcaatggtgaggcattccgcaggcggcagagcgtttgataaaacgtccagaccgaattgggatcatcgtgttccgcctgccagttcacgccagcagcttgcttggccagcggcaaccaaggttcatgaccagcgttgaagccaccattttggctgtcatcccatggatacggcgtccgagcattgtcacgtgagcgccggttgacacaggtgagcgcaacgtcttcggagtagccttctgccagtgcacggcgatagttgtcgtgcgcggaaagatcgttgaattgatcaatgttggttcgcaccgcattgaccatgccgagttcttggccttgatagataaacggacagccacgtaaaccgaagtataacagtgctaaggcttttgccccgatcgcattgcgaaattgcggctcacgaatatacttgcttaggcttcgcggttgatcgtgattttcaaggaaattagccccccagccaactttttgaattgccagctggcttttggcaatcgcctcgccaagcattttcggcgtccagttggtttgcttgaaccactcagacccggaagcgacgtcaatgtcggcgtaatgaaaatcaaaaatcattgagaagtagccgttttcgccaatgaagtcaccgagttgatcgtatgcaacgccagacgcttccccgatcgtgacggcattggccggcttaaaggtggcagcgttcaattctttgagaaattgatccagacccggtcgattttccgttttgcgcttaaccttgcctaacccatcgctgccatctggcgtgatggaagcaaaatcctgatcctttttgataaacgtaatggcgtcaacccggaatccggcgaggcctttggctagccaccagttgatcatgctataaatggcttgccgcaacttcggattttcccaattcaggtccggttgttgtggggaaaagacgtggtgataataggtgttgggctcaccgggaaccgctgtccatgacgagccagcgccgaagtttgagcgccagttgttcggcggctgaccatcatgaccctggcggaaaatatagaagtctcgatatggtgaggccggatccttgagcgccgcttgaaaccaccggtgctgatcggacgtatggttgaccaccaaatccattaccactttgataccgagatctttggcagttgccatgagctgatcaaagtcagccatggtcccaaagcgcggatcaatcgcctgatagtcggcaatgtcataaccattgtcaaccatggggctcttataaaccggcgacaaccaaatcgtggtaacgcctaattcttttaacttcggtaattcggcagtgatgccaggcagatcgcctatgccgtcattattgctatctttgaatgaggccggatagatttggtagaaaatttcttgttgccaccaagtacggctagtttcgttcatcatgactatatcctccagttagctaatgctgttgtatgaaaacatggtatcgattccatatgaggtaaaaagaaaactcaggcgctttgcctgattttcaacgataagtgcaaggttggttgcgtgtcttgggcgacttgtcggcccaacccctttaacaactcgtgcgtcgctgccgctgccatcgaagcaacaggctgatgcaccgtcgtcagcgggattttagcaaaaggcgcaaacggctgatcgtcatatcccataactgcgatgtcatcaggcaccttcacatcggcagccaacagactgtcaatcacgccgactgcgacctcgtccgagttggtaaacacggcatccggccgcacattcggcgctaagctcgcgagctgcttgccaactgcttgcccttctttggctgtgtgaatttgaccaaacagtaaatcttgcaccactaaaagctgatgtgcctgcataaagtctaaaaacgcttgtgtgcgactttgtccatggtgagcgccgctgatggtgccaccgctgacatacgcaaaccggcgatggccttgattgaataaatagtcgagtgcatcacgggtcgcctgataatgtggcaataccagcgaagtagccccggggatctggacatcggcattcacaaccacaacccgccccggaaaggccttcgcaactgccataactcgatcaggggcttcaactgaagctaaaatgacaccgtccaattcgcgacttttcagttgcttgagaaaacgttcttcagcctcgggatcatcatatgtctgggtaatcatcacttggtagccgtgggcatgtagttcccgttcaatcgcatcgaacaagccagcaaaaaacggattggtcacgcgggataccagaaccccgatgttgccagtggcttgggcgcgcaatgacgtggcggccgcactcggcgtatagcccaactgatgaattgctttttcgatccgcgtacgcttttcatcggagatgtagggatgatgattcagatagcgcgaaaccgtggtcacgccaacccctgctactttagcaatttcactaatcgtcgccattccttgcatccccttttatatggaatcgatttcataaatgagtatacagcgctttcagaaattgtcaagcattgactaaaaagattttttgcgtcccagtctaaaaaagccttacgccgtgtcgccacaacgtaaggcttgcgatcaaagaccgccattatcctttttaagattccatgacacaacatcactggccgctgacggtggggtgatgcgtgccgcggtgggtgcttcattgccaaagaagcgaccggagacaacgcggtagccttggtcaatgaataattcgaacaccgacacatcaatgaacaagcggatttcgactgttttcccagctggaaagccgaactggcgcaaactgccgccattattgcgattttcgcgctgaatcatcccctgcccgctatcagagtcgagatgaatcagcaactgatcatggtccccatcaggcagatgaatcgttgtcttttgacctgccgcaagcgtgaaggctagttcaaaggcgccttccaagttggtaacggtccactcatcatcatgctgctgaatgaccggtagatcttctaccgctgtctcccgcagacttttgatagccgggtgcggatagaggcaaacgtgatcatcacgcagcgtcaattggcgcacataactcaagaccccggcccaaccatcatcatctgttgggtaggtggtatctggcaagccaagccatgaaatcgccaaggtgccatcatcatctgtattcgccagacgagtcgcataaaagtcaaagcctttgtcaatgttttgcaaccgctggtgggttaagttaccagttgtcggatcaaagctatcggccacgagggcaatgttcggatagacattttcatattcgaaaaagtcctgatcgagaccttgtggacagtatactaagactactttgccattgatgaacgtgatgttcgggcactcaaccatgtagccgcaaaattcatcaggaatgctcagcggtgccacaaaccgccagctcttgtcggtctgcttggcataaagcagaatggcgccggtgtgatctggacgctggccgccaatcaggacataggtctggccttcatagttaaacaaaaatggatcgcggaactcctgggtgtagccagtaggcggtgttaagattaatggtttcggatccttgaacaaccggccatcagcgccgaaaacggcccctagctgggtgctatgccgatgccactgatcatcccgcgcattgccggtatacatcaagcgcaacgtgccgtgtgtcaccaacgctgatcctgtgtaagccccatgcgagtcatactcgttatccggcaatagatcgcctggcacccggcgccagttaaacaaatccttcgacaccgcatgcgcccacgacttcaggccatggaccgggccaaacggaaattgttgataataaaggtgccatttgttgttgaaaaagttcaagctgcacgggtcattgattaaaccagtatctggttgaacatgcgtctttgtccgccatttactcgcagcaacctgagccttcaacttcataatataatcaggcgcccaggacgaatacggctgataccgcgccgccgtactccaagttgcttctttcatgaacttaccaccttgtttgaaatgttacccccatcatatatgagttaggggcaatgtcaatgaagacagaaaaacaggtttctgaaatcttgatgcaatcatttttgggagggctggttgaccaccgaaaggacgaggtggcgccgcggtaattcgggatggtgaccgtgaagctagcgtggtgggcacggactttgagccaacgggcaaatccggcacgctggctcaaaacccggccttctcctaaagcaggcagcccatctgctttaggaaaatctcaccactgagcccatcgccgcggaaccagctcagactagcggataaatcgctgcccaagatagatcctgaaaagcgatccgcaaccaacaaacttgatgcaaaaaatccgcagcttaggccgcggatttttgattggccgatcggagggtggccgatcagcgattttttactttggaggagtaaaaatgaaaaagttgggttggggaaggaatgagtgtgtggctcatttctatgttgttaatactacaagcgatgtgtgaaatttttgtgatggtaaatgggtctttatgttaagtctgttgattaaaatcatctgctcacgacagcggtttaggcagaaattctgcccgataatcatgaacgtattgctcaaagctgattgctgggcgcccgagaacatttggcaatgttgtcgtaaccgttttggcgttacctaactgggtgatcaagtaaagcatcaccatgacattgacatagttcttcggtagcccgcgttgcagcatgaccttgcgaaaacgccacaaactcggcttgctataggtgatcggcacaccgagttccatcgtcatgatctgagcagcatcggcgtaggtgagcgcttgggcgccggtaatatcgagcttttggccaatatatgccggatcgcgcaggacaaccgcagcagtcgcgccgatatcacgggtatcaatgaaactagtgcgagcatgcccagcaggcacaaacagatcgcgatggccgacgatatcagcttggtgggtggtattcaaattttgcataaagaaacttgggcgaatgaaagtataaggcaagccgagttcaacaatccgtttttcgatttgatgatgcggcgtcattggattatgcgccaccccaagtagtgacacaaaaataacttgcttcacatgtcgagccaccaaggcatcgagaaaaggatacatatcctctttgggcttagccaattgtggcggccgaacgaagaagaccttgtcgatgtcagctaaggcttgctcgaaagtggcaggatcgagaaagtcaaatcggcgtacttgaaccttcagcccacttaacgcctgtttggcatgttccgaattgtgcacaccagcaaataggtgaacatctggatcatcttgcaagtcgcggatcagcggttgtccgatattgccagtagcaccaatcactaatagatttgtcaataactttctccttataaagaaaaagtgcctgaacaggcacttttttaatctcgatcaccgcttaattatcgcggttgaccctattcatacatataagcacgggttgccggcagatcttttccagacggccccttgctgatcaaatactgcatcacgtcaatgttgccagattcaaagctggcagcggccgcctgcagataaacatcccacatccgcgtaaattcgtaaccgaatttttgctgaatcggattgcgatgattattgaaattggtatcccaaatctcaagtgtgtgttgataatgacgccgcagtggttcaagatctgcaacttgcatgccagcatcgacaatgtgattaaggttttccgccatcccgggcacataaccatccgggaaaatgtatttgttgatccatgcgtttaccgcgccgccttgttgtcgcgtgatgccgtgaatcaatgccacaccgtcatcttttagcaacttagcgacatctttaaagtagccttctagattttccttgccgacatgttcaaacatgccaactgatgtgatgtaatcaaatggctcgcgattcagttcgcgataatccatatacagcacctcagcaacatcggatagatgttctgattcaatccgatccgaaaccagtttaaactgttccttgctcagggtgatgccgacgaccttcaagtgataggtcttagctgcgcgtaacatcaacgtgccccagccgcagccaatatccagcaatgtccgccccggctgtggattaagtttccgcaaaatatgatcaatcttatttaattgggcggtttctagatcgtcactccagtcctcaaagtaggcacaggaataagttaaagtcggatccaaccacagtttataaaaatcattgccaagatcgtagtgagaatgaatgtcttcttttgacttatgttcggtatgactttgcttcgggagaaagcgcatgagtttcttgttgcgcataaaactgcccgcattcgcataagccgccgcgattaattgttgcaatggccgtgtgccgccaagcacttcaatgtcgccacgcatataagcctcacccagtgccaacgatgcatttttcagcaaatcacggaccggaatggcctttttcattttaatcgtgatcgttggctcacctgtaccatacgtttcttccgtatgatcccagtagtccacgcgaaccggaatattgaaagagtgactgaacatggtatgataaaactttttttcaagcatgatggcctccgttttgagaagttacaagaagaattatacggctttttaaccaaagaaaaaacaccgccgtgaaaatggacggtgtgtagccgttttcatttaaaattttcgaaaacgctgctgtcgcttggcaatcagtgcctgcggatcagtagcaactaattctgcgagcttgggcttgatcgctgccttcaacgtcgtcgcgaaagtcgtaccggtatccggaataatgcgatcacagaccgctttagccaataaatcttgcggggtcagttgcatgaccgcggccgcctctttagcacggctggcatccttccacaaaatagccgcaaaaccttctggggatagaatgctatacatgctcttgtccgtcatccagacctcatccccaaacgccaaagccaaggcaccgcctgacccgccttcaccgatcaaaatcgcaagaatcggcgttgggagatcagcacaggtgtataacaaatcagcaatagcggcgccttggccattggcctccgcctctttgccaggatatgcgccgggggtgttaatgagcgtgacaatcggtcgatgaaacttggctgcctgcttcattaaccgtagcgccttacgataaccccaaggctcaggactgccaaaatgcgtctgcaatcgctccgttaggtcttgccctttatccgttgcaatcacggtcacggcttgctgatcaagccagccaatgccgccaatgacagccggatcatcatgacttgagcgatcaccgtgaaactcatggaagtttgtcaccaacccgttaatcagttcccgcgtgcgatatggtcgtggtgctctggctgcttgaactgtctcatacgctagcgtttctttatccgtcatgcttgaaaaagcctcccttattgctgcaactgtatgcctgtcaatgtgtttgtcagacggctacgcgtgatatgaagaacgctaggcaaattgatccaatatggcaatcaatccgtctagcgtcgcgtcaccatgcctcatcaaatgtcactgctcaggctgtgtgcaacgccaacaaatcccctaaataactaggctgatcctgccgctgtaccactgcatcaataaaaccgctttgcaaaagggtttctgctcgctgaaagttttgcggcagcttttggttaatcgtttgttcaatcacccgccgacctgcaaaaccaatcaaactgtgcggttctgccaacgtgatatcaccttgcatcgcaaaactcgcggttacgccgcccattgttggatcggtcaagacactgatgaataacaagcctgcattgctgtgtgctttaactgcggcacttactttggccatttgcattagcgaatgaataccttcctgcatccgcgcaccaccgctagcacagaaaagaacaactgctaaattggcgctggttgctttttcaaataaccgggtcaaccgttcgccagtcacagttccaagtgaacccatcatgaactttggatccatgataccaagcgcacagctttgaccaccaatcgtcgcctgacctgtccacacactgtctttcaaaccagtagcagcctggcctgctgccagtttctcggtatagcccgggaaatccagcgggtccgacgtcaccagatcggcatcccattcttctgttgctgtcgcgataagtgacaatcgttttttagcagtgattcgaaagccgtaatggcagtgcgggcaaacttgagcattgcccaaactctcacgatagctgccttgcttacaatacggacattgaatccacaagttttcgggtaaggctgcctcacgagcaagtgcttcttgggtcagttgtggttgtgacatgcagtatccttcctttcaaaacgcgttcgccaccccagataccgggctggttcgcgcctctgcttaaacgcgctctccagcccagaaacctgcatgtaagggccttagtcgcaatggcccaaaaccggccatcacgcccaaggccgcttacactacggtttctaaccgggctggttcgcgctctgccattttggtaaaaagtcgcgattgagataggcggtatcggctttgccggccagaactgtcggtgcttggaataacgccagcgcaaaatcccggttggttttgacaccttccacatgcaattcaatcagtgcacgatgcattttcgctaaggcctcgtcacgggttcgcccatggacaatgagtttagcaatcatggcatcataataggggctgatcttatcgccaggcgcaacgccggtgtcaacccgcaaccccatgccgccggttggaaagcgcagttgttcaagggtgccaacgtctggtcgaaaatcatgataaggatcttccgcgtttaaccggcattcaatcgcaactcctgatggttcaggtgtcgttaatgccacttcatcgccagctgcaactcgtagttgagcttggaccaaatcaacaccggtcaccatttctgtaattggatgctcgacctgaatacgcgtattcatttccatgaaataaaaatgatgctgctgatccatcaagaactcaatggtaccagcattgagataatcgactccttcagcaatggtcgcagcgaggtgaagtaactttctgcgttcaggtgacgtcaagactggacatggactttcttcgaccatcttttgactgtgacgttgcaagctgcaatctcgttctgggaaaacactggtatgcccgtgcatgtcgcgtaaaacctgaacttcgacgtgtttggcagggacaatgactttttcaagatacatcgtcggatcgccaaacgccgcttgagcctccgcttgggcccccgcgaattcagccttcaatgcagcagcatccgttaatttgcgaatacctttgccgcctccgcctgcgctggccttgagcatcaatggataaccaatggcctcccctgctgccagcgcggtttcaacgtcctgtaaaggatgactgcctggaatcacgggtacgcctaagtcaatcattgtttgtcgagcaacggctttgtcgcccatttgatcaatggcagtcggttttggcccgataaaggccaatccggcatcggttacgagtttcgcaaactcggcattttccgataagaagccgaacccggggtgcactgcctcggcaccgctcaaaatagcggcactgacaacattgcgcatattcagataagagtcggccgcccgcgatccgccaatacagatggcttcatctgcaagggtgacatgcaggctgtgacgatcagcgtttgagaacaccgccacagaggtgatgcccatttcgcgcaaggtctggataatccggaccgcaatttcgccacggttggcaacgagtacttttttgaacaaagttccacttcctcacacaaatctggtttcaatggcagtttcagccaatagcaaaaactaaatccgcactgctggccatgttttcgccaacataaattttgcctttgcccaaacctgcattgtcaatcagtttctccaaggtcacttcaatccgcagcacgtcgcctggacgcaccatgtggcggaacttggccttcttaatgccgccaaggtaggctgtctttcctttgaagtccggcatcgaaagcaatgcaatcgcgccagcctgcgccatggcttcaatctgcaacacaccagggaaaattggattaccaggaaagtgtccctgaaaaatctgttcgttaattgaaacattcttttgtgccactacggattcaccgggcttaagatccaagacccggtcgaccattaacatcggatagcgatgcggcaaaatggcctgaatttcttgtgcttcaagtgttttcttggtttcgagcataatgccctccttttaaacgcgttctccagcctagaaatctacgtataagagccctgaacgcaatgccatcaggttcagacccgcgtacacaccgatttctaaacgctcctactcacgctctgtcttcttcaattgtgactaatgcctgatcatattcaacgaggctttcattgtcgacgttaatcgccttaagtgtgccgctgacggtgcttttgatttcgttcatcattttcatcgactcaatgatgcagaccacatcgcctttgttaacgtgcgcgccgacttcaaagtacggatcagcgtcaggtttaggggaaagatagacaataccgaccaatggcgccttaatcgccgtgcctgtcggagcttctggttcagttggcaccgccgtttccggcgttaccggttgactaggcactgttgcctgagtattaacaattggcgccggagccgcacttgctttgaccagatgtaaagaatcgttgccaagcgtcagctctaattcatgcaaagaactttgctccaattgtttgatcaggacttcaatcatttcggtgtccatgatgctcaccaccttttgaaggccaagaccgcattatgcccgccgaaaccaaaggaattgctgagtgcatagtcaacttcgacatcgcgattagcggcatccaccaaggtgactgggcattcaggatcttgctcagcatcaccgacattgatcggcaatttaccttcatgcaacgcactaatcgtcatgatcgcttcaatcgcaccagccgcacccagtaaatgaccagtcaaagccttggtggaactcaccaaaacatcgtccccgaaaagatcgtggatcgccttgctttccatggcatcattagccttggtcgccgtgccatgtgcattgatatagccgacatcacttggcgcaatcccagcttcttcaatcgccagttccattgcccgtgccgcttgatggccgcttggatcaggcgccgtcatatgataagcgtcgctggtagcaccataaccaacaacttcgcctaaaatgttggcaccccgttgctgcgcatgttcgaggctttccaagataatcgcaccgccaccttcgccgaggacaaaaccgctgcgatcagccgcaaatggcaaacttgctttggccggatcggcagccttggataaggcagacagggctgcaaaaccagcaataccgatttcgttaacagaagcctcggcaccacctgtaatcacaacatcggctttaccactttgaatccgcatggctgcttcgccaatggcattcgtggctgaagcacacgcagtcacaacgacatagctcggtccgtgcgcgccaaagtactgagaaattgtcccagcgaccatgttgctaatcgcttcaggcacaaacagtggacttactcgatcaggacctttggcattcatttttgtgacttgttcctgaatggttgtcaagccaccaatacctgagccaaaaatgacagccattcgttcagaatcaacatcatctttagttaaacctgactgttcatatgcctcgattgcactgtaaaggccatattgcgtgaaaagatccagccgtttgctcagccgtttttccattcgcacttcaggtttaaaaccttcgacctcaccagcgactgtgatcccggtcttctcggcatcaaacttagtgattggccgaataccaatcttgccagcatccatcgttgccactgtttcggcaactgaatgacccagcggattcacagtacccattccggttacgactactcgttgcaatgtcattcctccgttcatgtacttagcctaatccaccagcaacagttaatgtttgcccggttatgtaggcattttcgaccagaaaacgggccgcatgcgcaatttcctcaggttgaccgaatcgctttaacggaatctccgccaaaatctgatcctgactagcctgactcagcgctgcggtcatatcggtagcaatcatgccaggtgcgatcgcattgactcgcacgccacgcatggcaccttctcgtgctaatgttttggtcagaccaatgatgcccgctttactagctgcataattggcttgaccgatgttcccggtcaaccccactacactggcgagattgataatgacgccagtacgtgccttcagcatttttttgaatactggctgactcacatagaaagtcccatctaagttgacgctgacaacccgggcaaaatcttccggtttcatccgcatggccaacatgtcactggtgattccagcattgttgactaaaatatcggcactgccaaacttgtccagagcggttgccaccagctgctgaccggttgctggatcgtcaacactgccaaggacagtgacgacgccatgaccaaaggcttcaagctctttgatcaactcagtgggaaatccgtggcgagcgtttaaaacaagatttgcgcccgcttcagcaaagtttcgggcgatcgcttcgccgatgcctcgtgaagcaccagtgatgatcgcggttttatcagttaatttcaatctgccttcactccgttattcaagtcaatgactgcattgaggctcgctgcgttactgatcaagtgtgtggtcatactgcgatcaatgcgcttaatcattttgctaagcactggttttggtcccagttcaatgaccgtgtcaataccagctgccttcagttgccgcaccacatcagcaaacttagtcggttcagccacctgggccgccaaaattgaccgcatgttttcagccgagaagggctcaagggccgtggtactgatgaccggtgtagctggatcaaagacatgtacttggtcaagggcagcacgcaatggtggctgcgcatcagccattaacggactatgaaatccgccagcaactttcagtggcacagtgcgaacgccttgatctgacaaccacgcttcaacctgcgccaagccagccttgctgccagccagtacggtctgtttagggccattgtaattggctggccaaacatcagacgcttgttgacaggcagccgcaatcacagcagtatcgccagtcatgacggctaacatgctgcctggatgggcctgacaagcagcggccatcgcctttccgcgggcggcaaccagcttcaacccatcttccaaactgatcccgccgccagcaatcaaggcactgtattctcctagacttaagccagcgagtgcggtttcatcgggcaatgccgcggctgctacttcatgcatggccacgctgtacgcaactaaagccggttgcaaaacatccggatgagcagcaaaatccccagtcgccaaaaactgcggcagatcgaagtccaaaactgcatcagcgcgttcaataatctctttgaatatcaaagtattctggtaaaaatcaatccccattccggggacctcggcaccttggccattaaacacatatgcaaaacgcaagcaagtacctcctcgtttcaatgcagacgtttgccgttaagcctgtgcctgcacatcgacttgacctgtcaataaggccgccatttttgagccagccaaaatttctttggcctgacgcatcacgtcctcaacaatgtcttcgctgctttcttcacgcttaactaagccggcaatctcaccagccatgaaggaaccatgttcacgatcgccttcaaggacggctttacgcaaactgccattaccaagttcttcaactgccgaaaaatcggtcgtgtcagaaagggcaattttcttttcaagtttcaggaaattccggctcattgggttcttcaaaacacgggcagcatgaccgacatacaggccggttaccagtgtatcaacgtccttggctttaatgacggcgtccttgtagttctggtggattcggctagacgttgacgtcagaaaacgcgtccccatctgaacaccgatggctcccaaactcaaggcagccgccacaccacgaccgtcagcaataccgccagctgcaacgacgggaatatcaaccgcatcgacaacttgtggcactaaggccatcgtggtaatgctaccaatatgaccgccagattccatgccttcagcgataacgccgtcgacaccgtcttttgccatccgttttgccatggcgacagacggtacaaccggcatcacaatcgtgccattttgctgcaaccgttctaagtagcggcttggatcaccggcaccagtcgtcacaagcgcaaccttagcgtcaacgatcacgtcaatgacttgttcgacaaatggtgaaagtagcatgacattcacaccaaatgccttgtcagtcagtgacttggcaatatcaatttgctctttgacccaagaagctggggcatgaccagaaccaatgatgcccaagccgccagcttcagaaactgatgcggcgagcttgccgtcagcgacccacgccatgccgccttgaaaaagcggatatttaacgcccaagcgttccattaatggactcattggcccactcccttcaagttgtcttaagcttcagccttttcggtgatgaagttaacaagatcagccaccgtttcaatgctttcatcggtatcaatcttaacgtcgaattcgtcttcgatttcgttgatgatttcgaaaatgtccaaactgtcagcatccaaatcattcttgaagttggttgtcagttggacttcttccggcttcttatccaattggtcagcgataatgttttgtaccttaggcaatacttcttcgtttgtcatgtttaatgttctcctttaaagttaactattttgtaagcgccagcagaagcggacccataagcgggcttctgcgactgcgagcgcatcagactcaaacatactgttaataagtgacgatcaacgaaccaacggataaaccgccgccaaaaccgctgagcaccagccgctgaccgcgttgtaagcgaccgtcttcagctaattgtgccaacaagatcggcacactggctgcactggtgttgccatgctcatcaatattgattggaaacttggcaggatctgctttcagctttttggtgactgattgcacaattctggcattggcttggtgtaagagataccaatcaacgtcatcaaccgcaacggctgcctgtgtcagcgcccgattgattgagcgtggcacttcggaaatggcgaattgataaaccgctcgcccattcattttgaaaaatggggacggcttagctgagggtgcttcggcaaacggactgtgattcgtctgttcaccagcaaccaaagccatctcagtatcgccgaaacttttaagatccacggcctgaaccgggaaaccttgatcattgatcaaaaccccgccagcaccatcagcaaacaacacggccgttcgccgatcatgccaatcgacaagccgagaaagcacctcgctgccgatcacaattccttgatgaaccgttggactcgtcatcaggcgatccgcaacatgtaatgcatattcaaagccggcacaggcaacattgatgttaaaagcaaaggcatggtctgcctgcaaggccgcctgcaaccgattcgcctcagctggcgtcgcataatccggactcatggttgccacaataataaaatcaaggtggtctgccgcgacctgcgctttggccaataactgctgagcaacatcgtaagctaaatcaaagtttttttgattggtgacgacatggcgcgctttaatcccggtgcgttccttgatccaatcatcggacgtatccatgtactggcgcaattgatcattctcaatccgcgtggcaggtaccgaataggcactggccagaatctccaaagcgggtccttctttctaatgacgatattcgtcaataaattcattcagattatccagtgcccgctcgatcaattcgatctgtggctcggtaaatcctttgacgaaactcgcaaccattttttgatgaaaggcaagatgggcacgatacatcaggcgacctttgcgactgagccgtaaattcacaacgcgtttatccgactcaagatgcaaccgctcgacataacctttacgcgctaaattgttgatggcaacgctcaaagtgccttgggtgacatgcagtcgtttagcaacatcgcttgaactcggcgtcgcatgaatgccgatcgcatcgatcgtatgcatttccttgatgcctaaatcgcggaactgacttttacgcagttcttcttcttccattcgtaaaatatcggtataaactctgatcaatttatcattgatccgcttgacgcttggcttttgggacataggtgtgcctccattgacaactgatttgatattcaaagtatcagttgaaaaaaatagcctgtcaagtgagctaagcattggcttctaccacgaaatgcaattctgcgtggcaaaccaattcatctccgatactggcagtcgtcgcaacgacccccatattctctcgaaccttaaccattttgaccgccagtgttagtacactgccggttggaacttgtgctgaaaaatcagctttactgatactgcctagataagctgttttgccagcaaactttggcgattttaaaatcaaaatggatgccgcttgcgctagtgtttcaataatcagtgttggcggcatcgttagttcatctggtagatagccgaccaaatgatcctccgcaacactgacatacttctcagccaccagcgattcatcaggcactaactcactcacatgatcgatataaaacaatggatatcgattcggaattaatgcctgaatggttgaggtatttaaagttgtcatagcttcgcctcctcttttcaaacgcgattgccggtctaaacgttgccggctcacgctttctttttaaacacggtcgccagcccagaaaaccgggccagcttttttcaaaacgcgttcgctgacccagaaatctacgtgtaaggaccctgcacgcaatggccaaagtgcggccatcacgttcaggcccacttacactccgatttctaaccgggccagcttttttcaaaacgcgttcgctgacccagaaatctacgtgtaaggaccctgcacgcaatggccaaagtgcggccatcacgttcaggcccacttacactccgatttctaaccgggccagctcacgctctcaactaaactagttgaatgttcaaagcatatgcagaactgctttgattgtcaaaccttttttgcgtttattatcttttgagaatattgatgtgtcagaatgaatacggtctcagataatatggttaaggggtttaagggttaccgaaaaaagcctaactatgcaaaaaaaaatctcgacttttttctggttttcgttgtcaaaaatggcaaaataaaaaagctaaagttgagaatacacaatagcttttttacaaaatttggttgaacttaccactcattagccgatgtttgggacacagcagcacgcaaatggttttcttttagccgaagtcggacaatggtgccaacttttttgggatcgtcaatccacggttcatgtcctgccccattcacggttaacagttcaccatgttgcacgacagcggcgatttcttgaccgagttcaggattcgcaaaggtatcatttgttccccagattaacgtcattggaacagacagctcgcgcaattgcgactctttcaatgcattgtggtacttttcttgattcatcgtccgtaataaggacaaggttgccagctgatagtttggcaaatgatcaaatgcatagacacagtccgcaaagctttgcggcaaagcactgacggcagccggatcagtccccatgcgatgcagcggtccccaagcgcgtttggctgatttagggatttgacgtttcatgaaccatttaccaagacctggcatcatcgccattttgagcaatgtcggtgttttggtcataagcattcggccgggattacccagtaaaatgagctgctgaacccgatctggataggccagcgcaaaccaagtcgcccaatgcgcacccatcgaatgagcaatgatcggtgctgatttgagatcaagcttatccatgacctggctgaacaaatccacggcaaaattgtgaacatctacttgctcatgatcaaatccatcgctcaaaccgccacctgggcgcgccatgacaaaaacatgatagccgactagttgcggcaacaacggcgctagcgcatatggatcaccagtattgccgggcacaaccagcacggggtcgccatgaccaaactctaagacccgaacccgcaaatcatcaggcgcaattttaaaccagcgcgtcttaggctttaagtgaaagtcagcccagagttgattttcagcgtttcgtgccgcctgaaaagcaacagaatcatgttcaagaattggttgcgtcaaaaaagaaccccctttaaaagtggcacaacaatgtcagatatagactcgttaccgctaacacttttatgccagcccatctgtcatggatgcttgataaatcgtttcgacatcttctaccgacaacggcacataggcgcgcgtttcaagactagcattggcaacagcagcagtcgccatggcatcaaaatgctgagtatccttgatcccaacttcaggcaaggtcatcgggaaccctaagcgactaatccagtcaaaagtcgcgtcaatagccgcttgcgccacggcataggattcatcaccttcaagatcccagacatggcgaccaaattgtgccaacatttctgctgtcgttgcgtccttggtcagaataaacgacatccaacgcggtgttaaaatgccaaggccgacaccatgggtaatgtcataataagctgatagttcatgttcaaggctatgcactgtccagccattttcgttagcaacactcacgataccgtttagcgccatcgttgcgctccacattaagttggcgcgggcatcatagttatcaggttgtttcaacgcaatgggcgcccacttaataactgtacgcatcaagccttcaatcatgcctttgctggcgtcattattttttgaacgatcaaaatattgttcaagcaaatgactaagaatatccattgatcccgccgccgtttgtctggctggcacagtaaaggtcagtaacggatccaaaaatgaaaccgctggtgtgtttggcccgactgtgccgagcttttcatgagtgacaggatttgaaatcacggagccgctgttcatctcactgcctgtcgctgctaatgtcagaatatcgacgactggcaattgctgcaatttccggcgagttacaccacgatctttgacaagatcccatgggtcgccttcgtaaaacttggcgctggcaatgacttttacagcatcaatgacggagccgccaccaactgccaaaacaacatcaatatcctgatccttcgccagcttttggccagcacggatagaatcgatcttcgggttcggctcaatgcccggcaattcggttaactgcaaatcagcgagcagtccagtcacggtatcgtataagcctgactttttgatggaatggccaccataaacgaacaaaacacgcgaaccaaattgactcaccgcgtcgtgcagctcaacatctaatcggcctgtaccaaaacgaatatcggttttattctgaaatcgaaaattcttcaaagttatcgctccttttttgagtgtgaacctgatcgtttcttattacattaattgtaacggttttaagggtaaaagaaacgcgaatagtggcaatttctcggatctcgttcagttgacgggtatcgatgaatccagctggtaacgtggggactcgctactttctcccaaactggtaaggaatggacgctggcatgttcctcagcacacaaaaaaagcccgacttaaacagccggactaccaacccactttttttcttagtgactcgctttaaccgcgtaaacaacccggattggagtggctcgcacgcgtaataaccgtgcggcctccacattgccatgggccgcgcggatgcataacatccgccgtgcctgctttgccactagcaatgtggggaagtttttagggaaaagtaaagcgaataactcctcattcgtcgcgccaatcaatgataagggacacctttctgcttgctgtaatttgtgcatagtgtagcatgtttctcagcaggcgccaaggggtaattgatgtttttgttattttacttactgagacttaatttaatcggcctttggcaatcaaatcggtatttaaaaaccagtgttcagccggatcgccttgcaagcggctgtaaggtagcggcgttttcccttgtgcagcaagttgcttgttgaggtaattccgaagaatccaaggctcttcaatttgatcaacctgcaattgcaaaaccgcttcgacatgctccggcgtggtcgcaagatcttgggcagcttgctcaagtgtgacgccagccaagttaaagttagctgccagttctttcttcgtgttgcgtcgttcaatgatggttaaagacatgattttgctcccttcaaagggtcataaacgccggcaaggttattgcaaggctttcaacacttgcttcagagtcaccgtcagtgcttctggatcaggcacgtttgccgcaaaggccttttccagtacttgaaacaaatcacgaacttgctcggcggttgtctcgccctcatcagtcaaaaacagttgccgctcacgttcgctgtgcggtgccattcgtttttccaaaagcccgcgttggatcaaacttttaatcaaattagacacgctagccggtccccgacttaattcgacactgacctgtcgttgattagcacctggattagcggcaataaacgtaagcaccttggcttgatcgctattgagatccaaattgcttaaatgttgattcaaaaaatacttctgtagttttgcgagttgataaatcagcccggaaatgttcgattcactttgcattatcaaaacctccatgataaccagtatacgtttttctgtttcatatgcaacagtttcatggacaccttaatgctgcattgttttattttgtaaaaatgcgtcaggtcattagcaccgccgcatgcctactcagaaaatgcataccctgcgacggatctggatcattatccgtcagttttgtccaaacaaaagtcggtcccaacgaaaagaatcccatcgttagaaccgactatttttcaatatttaattcggagaatctcactcatcatcgtatatttcaagcctgacgactagtcatcatccccatgaattaacgtccacttaccggaatcatcgttaaacttgctcatctgatcatggatttcatcatagcggtatttaccgtgcaaggcgccgctatctttatcgtaaacatcgacttccttcatgttagttgccggagatgtcacctcgacgcgatagtcatccaaatcaaaatcgtcataatcggccgccatttgcgcaacttcacgattgcttaaatcactgtcactgcgactctcatcgtcatcgcgactatcttcggccgattcacgggcattggcgagtgattcgctggctgcttcttgagaggccgaagccgaagttgattcagccactcgtgaatccgaggcggatgcagccgcaattgacgaagcagaggcactcgccgccgctgagctggatgaatccagtgcctcagttcgagcttgctgctggcggttttgaaagaataagaaagctgctagcaaaacaacagctgccaccaacacaatactaacaatgacccaaggacggccatgcggttgcttctgcccaccgccaccatttgatcgccgacgcgtcgcattcggcggcacagcccctgaagccagtggctgttgtcctgatggctgactggtttgcatctgaccattcacttcactaccttgtccttgcgccggttgttcttgtgccaggccacccttttcagcacgatattgggcaagattaaacccgcaattatggcaaaaggcttcgtcagcgctaacttgtacgccacaatttggacaatattccataaaaaaacgccccctcaatttctttgctgcaagctagcgcagctttttttaaatattagttggttgttgctcttggtagctgttgcagcaaccactgatacgctgctggcaacgcctgctgccaatagttaaatccatgtgtgccagccgctgaccagctattagtcggtgtcacacccactgcctgaagctgtgaggcaaaatgagtgacatcagtaaatggcacagttgtatcagcttgtcctgacgccaaataaactttcaaaccagcaagtcggtctgccgtcagcatgttggcaggttgatcggcatcccaacgggcctgatcccattggccatgagttaaaaaggctggcattcgtgattgggccgcttcaggtacctgctgccaaactgcaggcgacaaagccgcgacgatccgaaactgttgaggttcggctagcaccagtcttagggcaccatagccgcccatcgacacgccgccaaccgcataggcatccgcctgcgataaaagcgcaaattgttgctttaaatgtggtagtaaatcttgcatgattgccgtctgcattttttctgctggcgaatcaacgtaaaaactattgccaccatccacaaacaccaccactgctggatgaccagtcgaattaacagcttcatcaagtaagcttttcgaatccactaactggaccagattggtgtcatcgccatccatgccgtgcagcatgagcactaatggatagcgtttgtgcggatcgtagccagctggcacataggccatatatgaccaagatcgctgtagggttggcgcgaaaaaggtgaacgccgccaagctgctacttgtttgcgctaccgttgaccccgcaatagaaggagcggtctgtgacggtgtcgatgctgcttgcgtcttcctgctagactgcttagttatggctgactgccgctgacgactaacagtcgcaggcgcgtgctgctccgccgattgagaatgtcgaataaatgctcctattagcaaaaacatcaacacaccgaaaccagctaagacccatgccttaccgcgatgcacaggttaagcccccacgatataccagcaaccaagcacgccttgactttcctttatcttttttcaagtgcctacccccaggaactgacgacagttgtgacctacttcttaatcctacaacactgacggcatttacagaacatcttttattttttgatcgaaaacaccatcagtctctgggcaacaaccgggcggtgacgaacataaccaacgccgcgccaataccgacagaaaacccgatgccgggattcagcaaaccttgaatttggttgttggcactgctcatcaacggcgcataggcaaaatataaggccccgtagcctaacaaacctaacatgccagcaaaccgcatcattccgcgtgaccgaaaaagtccgaacaaaaggcctaacactgggcctatccccgctaaaataagcgctaagtatggcagattggtttgaggcgaagcaacgccagtattggttgcagcagtttccgccaaggtgacagcactgcggacaagatcatacaaactgccgccaacattggccgtggcgacactgccagcaccaaatggccaggcataggccgctgtaaatgccactagcgacgcgattaagtaaaccagccaaatgatgccgcctcttcgtctcggttggcctgctgtggttccaaggtgcgaccaccaatgcggcgaacgattgctcattttctgtgcttgctgcgccatcgggccattgtccggctgcgtcatatacggattaggatacggtggcaccgattgacccgctgctggccgcggcgctgtccaaatatcatcatctgagtcacctgaatcgtcatcgttaaagcgactagtataagacgccactggtcggcggtttgcaacaacataaatggcgacagcacagccaactgccaacacccatccagcgatcgttgaaaaactaaagacacaaaaaagtaccatgactccgatcaaggtatacaccatgtgagttgccaaccaatcgataaaatgatcgaaactatcgtcagttaggaccagactctttttgatgctggttgaaccactttgccgctgtcggcgtgagcgttctcctcgtacctgttcacgaaccggttcagatgcagctggttgttgtgactgctcacgaccaaagtccgtctcgccagcaacccgagcattgaagattgtcaaatctgcgccgcaattcggacagaatttggttccagccggtattttgaaaccacaatttggacaataacgcatcgtctctgccaagctagttccctccattttcatgctattagattcatcttgcatggttcgcggctaatagtaaagtttcggcgaagttttttaacgaaaactcacttagttgtcagtattggccaactttattcgccaactgtttagcaaagatgcgcgattggatcatggaaaaagccgcagactaaaaattctttgtcgttccaaatgccacaacctctggtcagagagggctagcgacgcggggctagcgcggtgccggtgcttcgagccgcctcatctagccgtcgactactctgccttggcactgtgatctttatctccaaaatatccacgagaaaacaaaagacgactgatttccctatgaattgcggaaaaccagccgtctatattgacagctgtcaattaaatcgcagcctgtccattcaagtcactatttagaatcgatggtcaaagcctcgtgggccgccgccgaagccacctgggtagccgcgacgtgggccatgctcgtgatgaccgtgatggaaccgtgcggcccattcgcgcatgtcatcgaactgtttgccttctggccagctaaggtcatccctagttgccaaatcggcagacaatttttcaatcaacgtcagtaattgcgcctgctcttcttcggacaaaccactgaaaatttgatcaggtaaatccgtcttcagtttacccgtcgtttcaataaactttttaccgtcatcagtgagcgcaattagctgaacgcgcttatcggtttcggactcgcggcggctgatcaaccctaaatcctctagtttctgaactaaagcggacaccgaacttggccgaatgtccaacgcctcaaccaaatctgaattcgtcagttcatctttattatcaagcagccgcaagagtcttaattgatttggctggcgctgtcgatcaccaaaacgcaagctgctagccacggcacccatgaatggacgcttttgaattaagccgccaaaggccttcaataaatcttctgatgtttttgtcatcgctattctccttgtcttttagttagtctactatcccatgaactaatagcatgagtataatccgttagttagtttttgtcaagactacctacttttaacgtttacgcggcctttccgaactgatctttaacatactcgcgataaattggatgcgacttgatcaggtcctcatgtgtgccgctgccgctcacccggccattttcaatgaagtagatccgattagcattcatgatcgtgcttagtcgatgggcaatcacaatcgttgtacgaccatgcattaatttagttaatgctttttgaaccatcatttctgattcggcatcaagactagcggttgcttcatcgagcattaaaatcttgggatcgcgaagaaaggcgcgggcaatggcgagtcgctgtcgctgaccgccggaaaccttgaccccacgttcgccgacttcagtatcgagtccctgcgacatggcctcaacaaaggtttttgcgtacgccatatcaagcacatgccataattcttcatctgtatagttgcgcgtcgccccatacgtcaagttataacgaatggtacctgccataattgttgcatcttgcccaaccagcccaatctgctcacgccaatcttcaacattcagatttgcgatgtcctgatccccgatcaaaatgtggccgctatcaggcgagtagaagcgttctaaaagactgataatcgttgatttgccgccaccagacggaccggcaaaggcaatgacctgattaggtgccgctgtcaccgtgacatcttttagcaccggcgtctcctgatcataactaaaactgacatgcgacattgtcaaagcttgaccactggcatcttttagcgggcgacctgtgcgactttcctcaggttgttgcagtaactcatcaatccgcgccgttgaaccgctcgctttcgctgtctccgcaaaaaactgtccaagcgttgaaaaaggcccaatcaactgggtgagatacattaagaaagcaaacaaggttcccatattcattgacccacttgcaacccgactggcaccatatgcgagcacgcccacaatcatacccatcattaatgtcgtcattactggctgggcaaccgcgtcataaactgcttccttcaagcccaagcgatacaaacgatcaatgcgggcatcaccggttttcttttcgactgcttcagcattggaacttttgaccaagcgcacagcgcccaacacatccccagcctcgccactaaaagctgccagattctcttgtcgtgaaaaagcaatcttacgcgactgagtggcaactggcaggaagatcagaataacaagcggcacaacagcaaacataatcgccgtcattttccaatccatcatcaacatcaaaatcagcgcaccgatcagttgcatcaaggctgtgaccatgcgcggtaccgagttggcgagtaaatccttgacttgagtagaatcattcaccagtcgcgacgtgatttcgccagacttggtggtgtcgaaataactgactggtaataccaaaagcttggcccacagcttattgcgtaatttggcaacgacatcttcgccaaaaaagcctaacacggcacctgaaccagcactgatcaacgctgaaccaataaacagcccgacaacgccaatcaccaaattcatgttgaccgcatgccccaacgcattaatcagcgacttggcaatggttggcacaattaattggccggccgtcgccactaatcccaaaagcagtccaagaccaagctgccaataatgtgggtgaatggtactgattagtttcatgaaactacggaaatcgaacttttttggtgttgactgccttttttcggctgccagcatcgtggttgaacgttgcatatgcatgtgcctccagttatcagctatttaaaatagttagttacttatatgtctaactaacattgtgctagtctaatccctttgttagtctatgtcaacaacaactaacaaaaagaactgaacaaattttgtccagttcttaaatcaccttgaatttccatgtcctcggttagtgcgtttgcaaatatgcctgaacgaaactaatcatgtcgcgcgactgttgattaaacaatggcggcagttgatcaaagtcaaagtattgcaaggccaacgtttctttaggatccgcttcagccaaactgccgccgactggtttgacgagataaaaacggcagatgatttgggcctgatcaccattgggataagttgtaaatccttggtcgaaagtatgcagtgccttgactggttccaccagtaaaccagcatcctctttcatctctcgttgcaaggtttcgacaaaggtctcaccgtactccatcatcccacctggcaagctccagttaccggcatctgtccgtttttgcagtaacaattgtccctgctcgttcaccaccgcaccggcaacggcgtttaagaaaatcggcatgtgtccgactttgctgcgaatctctcgaatataatttgccacttaactgcctcttttctcgaatcggttaatctgattatcaagcagtcagccaattggcgcaactagctgcaagacaattcgaacactttgtctagacgctggtatgcttaaaacaataagctcacggtaaatggtccagtcaaacagccccaaccaaatttgaccgcaaacaaatagacgaccatcctcgcaactaaaagtcgcaatgacagccgtctttttcaatcacttaagcaattgatttttggattagtccagcttgttcttgctgttgacgttcaacttttcgtcgaagtcataaacaacaggttcgccagtcgccatttccaagttcatgatgtctgcatcggaaatgttttcgatgtacttggtcaaggcgcgcagtgagttaccgtgagcagcgatgataacattcttgccagccaacagatccggtgcaatatgatcttcccagaatgggataacccgttcgagggtcactttcaggttttcgccgccaggaatgatccgtgggtcaagatcagcgtaacgacgatccttagcagctgaaccttcgtcagttgctttcaacaatggtggcaaaacgtcatacgaacgacgccagatgtgaacttgatcggcaccgtatttatcagcggtttccttcttgttcaagccttgcaaagcgccatagtgacgttcgttcaggcgccatgtcttcatttctggaatccaaagttgatcggattcttccaagacgtaatgcagggtcttgatcgcgcgggtcaaaactgaggtgtaagcctgatcgaattcaagaccagcttgcttaaccaattggccagcatgctttgcttcttcgacacccttttcactcagatcaacatccacccagccggtaaattggttggacaaattccattcactttgcccgtgacggatcaatactaatttcgccatatcagagaatacctcgcttttatgatttgacagtcttctgcctgtttacagaatctcatgttacaccattttcagtaagttcgcacccgctttctctggtatattggaaagggattgttgccaaaagaacatacgacgcaaattaactgcggcttgatttgcttttggcaacttttagcacgcatcacaatcataattgtcaccttttactgaaaatatttctggaggttcatgtgaaaaaaatttggctatcaattgctggtgtttggctcatcagcgtcatttactttatcgtctatctgacagttcccgccatgcaggttgcggttaatgcaagcggcctgttgtcattggttcatggtgtcatggatctaatcttacttggcggtgcgtttgccttaatcgcaggcgcgttatatcgaatatttcatcgtcgttaatgataaagacagttttttgttatactctttttgtacaactttaatttcattctttttattcagcactcatacatatctttggagggaacactatgtttaagatttgtccaaattgcggtgcgcataatactgccaccgctaaattttgtacccgatgcggcaccagtttagccggtgtcgttgcaacagccgaaacggcggttcaaagtgcacaaccgacttctgagaatgaagcctcaaccgccaacacagcagctgttagcgaacaatcttcagtgccaagcagtctaacttcatcgtcagctcagaatcaacctgtaacgccgcaacaagcgcaaagtcaggtcacaccgcctgacaacagtcagcagccgcaaaatcaagtgccaccacaaccagctggcacacagacacaaagtcagcaaacggctcaaggaccagcaccgacagcgcagccttaccagcaggctgatcaaacgcagcaacaagcacaaacaccgccagaggagccaaatcccacggtggaagctaccaaaaagtatgctggcagttactggcgctatctggtcgacagcattaaacatcctgcgactgtgacgcgaccatatcaccagtattttgggctaaccagtttagccatcacgattgttagtttagcattaaccattgccttgatgactggttccgcagtgtcgtcattgccaggcgcaattgctagtaatgtcttgatgaccttcctaaagttagtctttctagtggcggtcctgatgattgcggtggtcgccgtctattacttagtcgtcaacggcatgcttggcgaccggcgtcgatcttttctgacatttaccactgagtatgcctttcactgcaactggatggtctttttctcagtgtttacgctgctcatgcaaatgcttggtatgattaacatcggttcaatcttcctgatttggttgctgctatcgctgggcagcgggttattcgtcatctctggcacgtatatgttgttcaccgctcagtcaaccaaccgttttgataaaatctacgcctatctaatcgttggtattttactagtcatcgtgttcttgatcatcatgacgttcggcctttcaagtattctcggcggcattggacaaggtatcaatgattttggccgcagctttaacttttagacaagtatctactgcctaatccaacagctttttagacaaaaatagaccttaagacctgacacatgggtagtgtcatgatcttaaggcctatttttttggtcgtcactcaattgaccaatgcctctaggttttgtgcaagactcacggtatcggttgacattgtatgattgccaaacaagaccacaccgcttttcgcatcggctcgaaaataggctaaggtgctgaaactttccggattgtcgttgtacattccctgtaataaccgctggtcgtctaaccacatcacgccactggcatatggattaccatccccataattggcgctaatcagctgatgatagacttttaacggcatgattttcccagtctctgccgcaataatgactttagccaagtccgttgcgctcatatacacactgccgctgcccaacaaagtcgacaacagggcgttgctcagctcatctggttgataatcgttatcaccggctgttaggtagccctgcgcaacaggcatctgcgccgtcagcgccgtaaagttatgggtgtgcgtcagttgtagcggggtgatgatcgtttgctgtaagacattcgcaaaacttttacccgtaacttgccgcacaatccccgctagcactgcatagttagcattagcataaatgaagctgtggtcgccagttgatcccatctgctcgaatgtccagtccaaaatagcctgctccgaggttaaggtttgatcaggcgttagttcgtccatttgaataccagaacggtgatctaataactgacgaatcgagatgtccttactatgatcaattttcgggaaaaacttggccagtttggtattaaatgacagtttgtgctcggcaatcaaatgaccgatcaccagtgccgttaagtatttttcaaccgacgccaaaggaaacattgtctcgccgttattggcttcatgttgaccatgatccgcgtcaccgacgccgccagtataaacaatctgaccgtttttaatcaaagccacactacccgtgaacgccgttttcttaatcaaggcttgggcatgtttgccgacttgcgcttgcggcaccggacgcgccacaattttactagcttggcgttgatgatacacccacgccatcgttaagcccgttgcagccaccaacgctaccgccaatacaatcacaatcagccaacggtgtttatgcatcgtcatcgtgctccttgggctgcggcacacgcgcgtatgttgattgcttgtgcgccgtaccagcaattttcttaacgcccaatacatctaggaaaaaggtgaagatcggaatgccgacaatcaatccccaagtgccaaataaccgctctgccactaacaaaacgacaaaggtaaagaaaactggcagctgtgttcggctgctcatgaacttcggattcaagacataagcttctagcacatgaatagctgcaatcatgatcaaaatggtgaggacatcttgccaaccgccgacggtataaccaataatcgtgagcggaatcaaggaaataatcgctccggcaactgggatcaaggaaagtaaaaagaccataatcgcgagactaggggtgttcggcatttttaagaatagtagcgtaatcgttgtgatcacggtattcacaactgcaataaaaatttgtgcttccatcacaacgccaaaagtattgataaacttcatcgcgaaatattgcagatctttgaaataccagccgaacggtgaatccagaaacagttggccaaacgcaggcaagctgtcaagctcaatcgtgaaaaagaaactaagaatgaaagagacaaacagcgtcaatcccatggcgccgatattgccggcgtattgtagcaccgtggtcacgccagttttaagttgttccgtcaagttgagactcttcgtgctttgcagcacccattgcatgacctgattgttggcgaacgcctcactgttataaaagttttgcacagaattaaacaagccaatcgtctgatgaataatcgctggcacgtaatgcactgcagcgtagactaggcctaggatcacaagtatgtaaactggcaccacaatcacaaatgggcgaatatgaacatgccgctgaacagcgtggactaagcggctgactaggaacgcgaaaatgaaggtcaacaaaatatcgctcataatgctgcgagcaaaccacaacaagagaaagactgaaaacaacaccactgtgcgcctaaccggaagattattgatgaacttttcgtaacctgacatacttttccccacattcttaacgagatacactaagcctgccgcaaaatcaaaaaaagcgcaagcattcgctcgcgcttgccgaaattataagaaaaccttcaagtgttgcttcgttgcctttttaactgactgaagctggccttgaataataatgcgatccacttcgccttcagttggcgatgcacacgtcaccattgtaatcagtttcttaccggcaacatcatcaatccactgaacttgggtttcattaacaacctgtttactggtcactttatacgagtaaactttcttcatatcggtgatataaatgatatcgtcttgcttcacatttttgagcggtgaaaacaaaataccttgattggtcatgtagtgaccagctaaagcataattaccttcgcccattttttgatcggctttcatcgtgcctgccccggcactgagattctcgtttgataaccctttaaaaataggcaatttcaaaccgacactgcgaatggcaactttgccaataggatgcaggtcacggttaagcgcggcattgccaactgtattgatatcaagcgctttgacccctttgaaatcaaaggttgctttgcgtttttcatttttgttgacattgtcacggtcaacttgtgccatcgtccactggctaagatgatcgaccacaaataatttaatgggttcattgaagatcagcgctaatcccagaaggataccgagcgtaaaaatggttcgccaaagccaacgatgtttacgcggtggctgttttttattagattgtgtcatcgtcatcctcctcggggaaatcataccttgaaacgttgtgagattcaagcaagggtgctcgggtaaacggctcaattgcggtttgttattttgataaataagttgtttttctgttctgctgtcgttgggaggttatccttagtgtccgagctggctacgcggcgattcggggtggcgaccgcgaagctagagtggtgggcacgacttcgagcccatgcgcaaaacccgcgcgcagtctcgaagctcggcctccttgtaggcggtaaaccgccaacaaggatttcaccactgagcccatcgccgctccgccagctctccagattctattttaattttaagacggtattctgatctactcatgcaagaacgactcacaattgaagttctacatgccccacctgccatggtatactattgaaagtttgcataggaggcgcctgttttgaagaagctttttcaactctataagcgttatgaaatgatcatcaattacctgtttatcggcggtttgaccacgttgattaactttgtcacgttcttcgccatgcggtattttggtattggcttagttttgaccaatacaacggcgaatatcgtcagtgttatttttgctttttttgccaacaaaagtgtcgttttccacagtgactactcaagtaagaaaaagttctggttcgagttaatcagctttcttgtgttgcgtggggtctccttgttgctggataacttgatcatgatcatcggggtcgattggctgcatggtaatgagattctcgtcaaaattttagatcaggtcatcatcgtgatcgccaattatctcttctcaaaattgattttcttacgcaaaaaataacttcatgaagtgtgctgacccttgtctttgttgcaggcggctagcacgctttttttaagttggcagcaaaaatagttgcttggtttggtgcagtgtcacctgaatcggggttgaatattcttcgccatcaatttgaatcggcacagttgctgacgtggcgaattcaaatgtctgaccttgtgcgtggtgcatggcgcggtgaacggaacggccgctgagaatggcgaacagcacctgaagcaaaatacccaatttttcgcgatgcacctggacaaaagacaaggtgctgcgattatctgctttatttgggaacagtcgcaacccgccacccaagaatggatgattggtaaaaacattgagataagcgttgtcgatcgccatgccttgaccgtctacctgccaagtcgcgggaaatcttttctgttgccgaagtgctttcagaatgctggcggcatacgaaagatgaccaagctttagggcatttaatgccgccttgtgatcggaatggtttgtttgatacacgatttgtgcatccatgccaataccaaagttattaataaaatactgagtcccgtacttggccgagtctgccaccccgattttcaaggcatgcggcattgccgttgtcaaagccgccgcagcttttttcgggtccagaggaatatggttggcgcgggcaaaatcatcgccggtcccggttggcacatagccaatggcgacttctggatgaccttgtcgctgcaacccattcacaacatcgtgtagcgtcccatcaccaccaatcacgatcagttgaagatcgtccatcttgtgttgataagccttgatgagtcgttcggtcaccaacctagcatcaccagccttgcgcgtctgactaatatgcagtggcgcaaagtgagactcaatgattgcaactaactcaggtaattgctttttccagcgggcattccccgcactgggattcataatcacttcagcaaaaggcattttccttactccgtctcattagataattggtcaaaaagcgatgatattctttatcagcgatgaccacttttatcatatgatacctttttcaaggcagctagacacgtattgcgcttgaaaaatcacctttctcaatcgccggcaacacagcgactaaaaacagcacggccatcgccgtactgcttaatactcatctttcttctatcaccagttacgccacaggcaccttgtgtgtcttcaagaattcactcagcggtaccaatctttccgcgtagtaacgcttcttgaacgcagcaatcgtgtctgcgtcaaactggttaggatccaattgcagatgctcaactggaattggccgttcgttggtgattttggcatcaatcaaggttggtttgccggcagcccggttggcttcagctgtttcaaaagccgctggcaattcgtcaacttgggtgacggtaatgccggtcatacccatgcctttcgcaaccgtcgcaaaatcaatcgctggcatgtcgatcccgaaccactcgtgaccatcgtcctcctgctcatcttcaatgtaccctagcgcattatttgaaaagaccacattgatgattggcaaatgataacggacttcggtatccaagtcctgcatcaccatcgccgcggcaccatccccagccaggttaaagacctgtcgctttgggaagctcaattgaccggctaatgcggccggcaatccagcgcccatcgtggcaaacaacccactggtggtccacgcttggcgcccattgactttcagtaaccggacagcattttgagtaacatccccgacatcaatcgcaaaaatggcatcatcagtagcaatgcggttaatttggccgaaaactggttcgaagcgcattttcccggttgtccgggtcatcatatcgtcattatactgatgccaatttttcacgttgtcgacattggcttgataccagccgctgtgtggtgcatcgtcactacgatcaatcattttcttcaaggttgccggagcatccgccaaaatggcaacatctgtttgatggcgcttgcccaatgtcttcgaatctgcctcgatctgaataaacttggcgttcggtgagaacatgacttcagcaaacgggtaattcgaaccgacaaacatgatcaagtcagcaactcgcaacgcttcattcgctggttttgaagccacccgagctgcagaaccaagcagtgattcaaattcgtaagggataatcggcttgccaagtgctgtcgtaatgactggcatctgtagctttcttgccagcgtcatcaccgtatcagcagccccacggacgccttggccaacgtacatcacgggccgttgcgctgcgccaattaagcgcaacgccgcatctacttgctcgtcgctgccagctggtaaaactggggtggcgtgggtagctgctgcactgtagtagccatcggctggaatttcttcggctgccaaatcattgggaatcacaacaatcgcagctccacgtccggcataagcacggcgaatagcctcgtcaataatatgcggcagactagccgccgtggtaaccgtccgcgcatacaaagcggcatcttgaaacatcggatcttcatccagctcttggaagaaatcgtaattcatgaagcgttgttcaacttgacccacaagaaataacgtcggcaccttatccattttagcgtcatacgccccttgaaatagatgggttgcgccgggtcccgctgatccaaatgccacgccaatatgcccagtcaatttaccatccgctactgcagctagcgcaccgacctcttcatgtcggacgtgaatatactttaaattgtctttctcttcatccagcgcatacatcatattgttaaaagtaccgccggggattccgtaaacatgtgtcacaccccagctctcaagtgtcttcaacgcggcgacaccagccttaatggtctttaccataagaatccctcccaaaaagtgagcgcgaacaggcacgtttagaagtcggcacatatgtgggcttctgcgacgacgagcgcgttattcaatatctctcgcggttatactagatttgttttaggcataaagcaattattttgttcagagcacgaggtgaggttgggacatcattcacagccaacaacaaggcgacaatttccatacaaagctgaaatagttggccttattctcatggatcaattttattgagatttaaagataccagtgccaaggcggagcaatcgtagaccagatggggctcagccgtgcaaacaacacagcgaccgggctttgtcgctgatgttgttaggcgacttcgagaccggtttttgggctcgaagcgccgtcacgctccaactccgcgtcgcaagccacatctggccggagattgcggagtttggcacggcaaagaatgttagccctaagcttcccctcgattagccgtcatcatctaaaccgcccaatcgcacaacaaaaaaacggcaaacctccccatatcaaggaaagcattcgccgtcatcaaacttatttcaaatcttcaatactattaatattcttcatatacttcggcactgccaagccgacctttgcaccatctaagttcacgccaagatcaacaacttgattcttataatcagaataaagttttgctgacgtattcggtaaccaagcagaaacctgagcatcggcagctttagttgcaactgaagcccaaactggttgtggttccattgcccgaatcgtcacgttataccctatttgccgcaaaacagttgcaacaacattggtggatgcgatttccgaatcccacgcaatataggtcatcgtcagtttaggtttgccgctaacatgcgtcacacccttggtccactgtgcgatttgttctgggtgcttcttaacgaaagctttggctgcctcggcaggatctttgccgccgttgaccgccagcatcacactggacatttcttcaggcgtccagtggaactgatctaatacctgataagcttgcggtgcatcctgcttaaggcccttccgcacgattgtatgaatctgttcggttttgccgtaaacatttttaggatccttgagaaactttagtggaaacttggtgaacatccagtgcggcgtccagccagtgaccacaatcggacgtttgtcggcaatcgccttttgcaacgtactggtcatagcggcggtggaacttggttgcaactgccactttttatccacaagaccataagctttcagcgctttgtctgtactggtcatgaccccagcgccagcatcaatcccagtaatggtgtaattgatttgcggtcccagcggctctttagcgtcatacttaggctgcgtgctgctgcaggcggcaagtgcaccgactgtgatcaacaccgctagcgccgcggcaatctttttcaaaaaagtcaaacggccacctcctaacgacttcgattgagactttgcgtgatccggtcaagaatgatggccaaaatcacgatggcaagcccggcgacaaaaccgccgccagcatcattacggccgactgcaaagtaaaccttcgtacctaagcccatcgcaccaatcatcgaagcaataacaaccattgacagggccaacatcatactttggttgatcccagccataatggttccgcgggcaaacggcaactgcaccttcaacaattgttgccaaccagttgccccaaatgctaccgctgcttcatttaaatccgctggtacttgcgtaatgccaagctgcgtcatacgaactgtcggtggcatcgcgaagataaccgaggctacaaccccgggtaccatcccgataccaaagaaagcaacggctggaatcaggtaaacaaaggccggcatcgtctgcatgaagtccatcaatggtttcaccactgcggaaactgacttgctttcggccgcccaaattcccagcggtaccccgatgacaatcgctaacaaacttgcggtcaacactaaggttaacgtttgggtcatgtcacgccagaaaccaaggttccaaatcaacagtaaaccaagtaattcaaaaatcagtaagctgcgatatttctggtcgcgtttcagataccaagttaacgctagtactaggatgatgaataaccagatgggaataaaatcaaagacagcttggaaagcattcacaatgccgccgatgaagttcgttaaaaccccgaagaagccggaaaactgggttaaccacgcaacaaatgaatcgacccagtgggccaatggtaatgtgggaatgctgattaaaatgttagacattgacattgacctcctgtccagataatgcacctaagacggcaccgcgaatgatgatcccgcgtaagcgatcatgatcgtctaccactgcaaatggtaccggtgtagtggaaacggcgtctagtaagtctgccaacggcgtatccattttcgttgttggcacatcagacttaacaattgagcgcagatccttttgaccggcatcaatagctgaccgcacgtcgtcagcatccaaaataccgacgagtttacgtttagtatccacaacatacaaacttgaaatttcattgtcccgcatccgccgggcagccaaacgaggaccatctctatcaatattgactgtgttggcccgaatcatcacattggcagccgtataaacctggctgcgatcaacaccttcaatgaatttctcaacataatcgtcagcaggctggctcaaaatttcttcaggcgtgccaatctgaacgatttcgccatctttcataatcataatgtgatcgccaattcggagcgcttcgttgaggtcatgcgaaatgaagacaatggttttttgcatatcttcttgcaagtccaataattcatcttgcatatcgcgacgattcagcggatcaagtgctgaaaaagcttcgtccatcagcagaatttcggcatcgctagccagcgcgcgggctaaaccaacacgttgctgcatcccaccagacaactgatctggatattgatcggcaaaaccatttaagccaaccaaatcgagtgctttgttggctttcatctcgcgttcatctttctccatcccttgaatctcaagtccaaaggcagcattttgcagaacggtccgattcggcagtaaggcaaagccttggaaaaccatgctgagcttttgccgtctaacttcacgcaatgcctgcttatcaagtttggcaatgtcatcaccgtcaatcagtacttgcccgtctgtcggttcaatcaaccggttcagcatccgtagggtcgttgatttaccagaaccggaaagtcccataatcacaaaaatctcaccggttttaatcgaaaaatcagcacgatcaacaccaaccgttgcgccggttgcttttaaaatttcaggcttggtattgccggccttcaacatttctttcgcgcgattcacgcgcttaccgaaaatcttggttagcccgcgaacctcaatttttgtctcggcattactttcaactttgtgttgcatctactcactccttgttttgaaaaacgtttgtcatcgaattgaaacaatgctatccattctagagatagtttgtgtgtgattcaaatcacggaatctcattttcattttcgccgccattaagcgccacatgacgttctgcaattggtgcgcacaaaaaaagcccgtatccgcatggggttatgggctagggacaatcagcgactcgaattttgagagcttctctgaaagtcaaggatagatgaaatttagatgggatctttttcattattcacaagctgttaagattaatctctgaaaaaggcaagtgttcgtcgaatggtatttcgttgcctaatgtgatttgatctgggccagtcatggtatcataagccagcacgcgaacgccattttgtttagcggtcgtgatggcagtcactagttcaggaaaacggtcccgataaatggtcatttggcgaatatccggtaattgcacgatgaacaataaaaatgcctgatacccttctgcctgcgccatcgtcagcgtatggacatgcttgacggcgcgagttgttggcgcatctgggaaagctgctagggtgccattagccaacgtgacgcccttcgtttcaacaaaccacgactggccatcagcggctttcccagcaaagtccagtcgcgaatcgcgccaagtcgattctggatgaacggcgtatggcaaagcgagtcccggcaattttaaggtgccagcttctaaacattccttggcaacatgattgggtgccagactgtcgatattgatccagcgaccttgccgttgaacagccagcaagtcatagtgcgttttgcgatttgggttatcaacatagcggacactggctaatgatcccggaatcaaaatttctttattgcgtccggtattattcatgtggacaggttcgacggtgccattcaggtcaatttcaacggtaaagcgactcacccgtttgatgagctgcccgacgctgacattttggtagtacatgcgttacttcctccccttgttgggtgttggccgccatgaaaatagcagtcgcaacgatccatgaagaatcggtacgactgctcatttttgctgcacttgaccgaaatcagcgaacgataatcaccgagaccgatgcatcgcgagcaacttcgctcgcaacatgaccaagacgtaaccgaccgcggcgaacatgagaacccataatcaccaaatccggtttgaaggctgggatcacttcgtcaagaatggcagctgctggccgcccttctgcaacgatcggttgtgcgttttgaacgccaaatgccgttgctttttcgacgtaagtgttcagatccttagccagtgtttcccgggccgcatcaacatcatcaggtgtcaatgattggaaaatattgagatcgccggtttcaagtaccgacacgatccccaacggaatgtcataaatcttggcaaccgtgcaggcgtagttcaatgccttgcgcgaggagtcgtcatcatcatcatcaaccgccaataacaaccggttataatgcatggattcaatcgtcaaatcatcttcagtaaccaaaagaaatgcccccttgcaagtttaggtatccctaacaatgccattttatcacatgtcgcccttattttccgcaaaatactgcttaaaccgaccaacataattatggaacatatatttcatcaataaccagcgcttgaatgtcatgtccggtttataaaagaccgtcgtaccatagcgtttctctttaagtaactgcaaggcttcctttttagcttcgttatctgcagaatactgcttgaaaacacgctctggaacccctagccacaatttatacttgctgtggtcatcattaccataaaccgttggcgcgtccttcaaatctcccaggatgtaatcgcgaacaggccagctggcaagattatacccatttaaagtgacgaaaaagctactccggccttgacgaatattaatttcaaacagcttgaacgtcttgtcacgatgatcatacttcatatcaaaattagcaaaaccggtgaacttaattgcttcgaggaatgttttgatctgatcgtacaaatcctgatcgaaagctggcatgatcgcgacatagttaccgattgaagaaggcgtaggatcctcaagtagcggatgacctaagcacatcattttaacgtgatgatattgatcaacataacagttcaaagttcgcatgttactgtcatcacctggtacaaagtcctgcaagatgagatcagacgtatagccattatcatagattttggcaatcgtattcgtcaattcaacttgcgagtgaatcgtaaacgcctttttgcggccttcaaagcgaatgttcaaccattcaacggaatcagtcggcttgagtgctactggaaattcaaacggtgccgtgatggttgcgttgctttcatacatcgacttggtgacgattttggttgccggatatggcaaatgatactcttcgcaaacttgatagaagctctccttactattcaggcgcttcaacaattcataatcaacatatgggcagatgaaccactggctcaactcatccttatgtttggaaacaagttgggcataggtgtccccgcaagcgattaacaacagtttgcctggagcatctgcatgtaccttggctacctgccgcatattttcaataaaagtcggatcggaatcaaaatgctcgatcagatggacattcacgatccgcgaaaaacgcgttggcgcaagttgttcgcgcgcataaacatcaatcgccccaccgatcatctcgtggaacgaacgcgccataccatacacattcatgtcactgccaagcaggatgggggtaaaactgggtgcatctttcatctgaatgataatctcctcgttcaataagacgcgaattcggtcaactgtgcgtcttgaaattttcattttaaaaccttgtctgccgattcaattattgacatcaggcatcgttagactcgttttgtaagacgcgaagttgattttatcaatcagcttccgtccgttgcccccgaattataccataatgccccaccacgttcacttgcgtcaggataccataacactttttcaataatcatgaatcaaaaaatactaggtcatggctacctagtattttctgaaactcactcaaactgttcaacttgtacgccttgttgacttggcgccaccacctgtacttgccactttttccaactttcttgagcttgcgcttgtatttgtgcggctgccgcagatgaggctgtgatcgctagcatggtcgaaccagaaccagaaatcaaaagaacaccaccggccgtctgcaccacttgatgagccgctgaatagtctggtattaattccgcgcggtaaggctcctgcatccgatcagtcgcaacttggcgtaataacgacatgtcgccatcagccagtgcccgggtcatcaaggtacaacggcccatttgataggtagcatctgcataagtcatggttcgcggtaaaattcggcgggcatcagcggtactgacagcatagtcagggatcaaggtcacaaaatgcaactttgagctgacggtatactgccgaacgactggttcattttgcgccatgatcgtggcacatagctgcccgtaaatcgctggtgccgcattatctggatggccttccatttcagtagcaaatcgcagcagcgccgtatcatcccaaccggcttgataccacgcattagcagcggcgataccaccaactacacatattgctgaactgcccaaaccgcgggcactcggcaccgctgaatcaaccacaatccgcagattaggaacaggctgatcaatcgcctcggcaaatttgctaaacgcctgataaatcaagttctcactattggcgaaagctgggtcatcgccaatgatctcaagcttttgggtgctcatttcaaacgtaaaatgagctttgagatctaaggcaagtcccagcacatcaaaaccaaccgctaagttagcgctcgttgccggaacggacacgctgatcatcgttgaatacctccttcgccgccccaataatagcttggcccatatcggttggtgccacaacaaccttttcctgcggtcttagctgttgaaggtgagcaagattcggcggaatcggcacaccgctaacctgttgcaacatttgcatcgcagcaaagtcatcatccggcacgtgcgattgtagtgccttggccaccacgcgtggaaatttataagggcttgcggtggctaaaagcacattcggggtgttatccccagacgccgctcggtactgctgttgaaccgcataaccaacagcagtgtgcggatccagcaaataccgatcccgatgccaaacttcgcgaatggcatctgccacctcttcatcaacagcaaaaccgccagcaaagtccgcttgaatcgcggtcaacacatccggccgaacttgatagcgaccagtcgtctcaagttcctgcattaaatgcgcaacatacgcgctatcttcgccactcttataatacaacaggcgttccagattactggaaatttgaatatccatgctaggtgccactgttttcaaaaacggtcggttgcgatcatacacaccggttgccagaaaatcagccaattcgctgttggcattggcggccgcgattagtttatgaacaggcaagcctagactcttagcatagtagcccgccaacacatcgccaaaattcccggttggaacagtgaaattaacctcatctcccattgaaatggcctgtgttttaaccagttggctatacgctgcaaaataatacacaacttgcggaatcagtcggccaatgttgatggaattggctgctgacagggttacttgctctgcctgcaaccgagcagcaaagctagtgtcagtgaacaaggttttcactgcgctttgggcctgatcaaaattgccagcaattgggaaaactcgcgtattgtcactgcccacggtcaacatttggcgctcctgaattggactgacaccatgattaggatagaaaaccgtgatcccagtctgcgcgacatctttaaacccttgtagagccgccgttcccgtatcaccgctggttgccgctaaaatcatgacccgatcatcaggatcaagtgccaactgcatcaagcgcggaagcaactgcaagccgacatccttaaaggcactggttggtccatgaaataactctaaaacatgaaaatccccgacagaacgaactggcgtgatgcgatcatcggaaaaatgctgatgataggcaaaatgaatcgctttttttagtgagtcggtgttaaaatcaggcaacaggatcatgagaactcgctgagcaatcgtttcataatctaaatctaacagttcatgaatgttcagcgtctgatcggccaaatgcggcaggacaaacaaaccgccttcttcagaaataccttgtttgattgcctctttgctggttttgctaacctgatgatcccgtgtgctcgtatatcgcatttgaagaactcctatctcattcggcttgaattaacgatatggatatgataatctgttcgcattagaaaaacaagtgtctatattttataaacaaggagctgagaatttatgaaaattgccatcttaggttttgggactgtcggcagcggcgtttacgatattattgcaaatggtgatacccgaatgcgcgtcaccgctattttcattcggccaacgcaccctgcgaccatgcctgagatgacaacagaccttgacgccatcttaaacgatcctactattgatgtgatcgttgaaacaatgggcggtcttcatccagcacatgattatattttacaggctttgcagcacgataagcacgtggttaccgctaataaagccgttgtcgctaaatatttgccggagtttaccgctgttgctgcccagcatcacgtgcaattttacttcgaagccactactggcggcggcatcccgtggattcgcaaccttgaacgcgccgcacgcattgatcagatcgataccatcgaaggcattttcaatggcactagcaattatattctcgatcagatgcaacgcgcccacctcgattttgaccccgttctcctagccgctaaagatatgggctatgccgaagccgatcccagtgctgatattgatggcgaggatgtggtcaacaagctgaaaatttcggcagcacttgcctacaacatggccccaccacgtgatgtcccaacttttggtattcgcaacgttagcaaagccgacattgactttttcgcaagtcaacatcaggttttacggttgattggtaaaagtaaacgtgacggtgaccactatagtatggtcgtggaaccgcgcttgtattcagaaaccgccttggcggccaatacatttgaaaacttcaatctaattcgcctgcatggacaaacgattggcgacctgcaattttatggtcaaggcgccggaaaatacccgacagccaacgctatcgtgcaagatctgtacgatatccttgaaaatgccccgcatctggaccgtagcttcgatcagccgctgcattttgacgccaacctgaatgtcaccgattacgttttgcgcgccgatcccatgaccttcgcgatgttcaatgatcgcgaaaccgagatcgtcaatgaccggctggtgatcaagcaaataccaactggcgacatgcacaaactcatgcgcggcgttttagccattgatgccgatgcttttatggcagcaatcggagacagtgagttggctgctaaagacgtccttcaccagcgagatcaggaggtgatcggatgaaggtcgttaaatttggcggtagttccgtggccgatgccggtcaattccagaaagttaaagccataatcgatcaggatgtgaatcggcaaatcgtcgtgattagcgcagctggaaaatatggtaatgctacccgaaaattaactgatacgctctatttaattgctgacggtatggaagccggtcgagatgtcgaaccgctgtttaatcaggtcttggctcggctagaggccatcaacattgcgctgcagctcaatgtgccgctcatcaaactgttgcatacaattcgccatcatctggccattcgctattctcgagactatctggtctctcgcggtgagttcttgacagcccacttaatggcagcctacttaggctatacttttgtggacgccgccaatcttttgtttttcaataaagcaggcgccattgatgaagccaaaactcagactgcttatcaacaactagccagccatcatggtatcgtcgttcccggtttttatggtcgcgacgcagacggacatgtcaagctgatgccgcgcggcggttctgacatttctggtgcatggctagcacgcttggcccacgctgatctctatgaaaattggaccgatgtttcaggcattaaaatggccgatccgcgtatcattaaagatgccgacagtattgatgtgatgagttacgacgaattacgcgaactcacctacatgggatttagtgttttccaagaagaagcggtgcaaccggtccgtgaatgtggcatcccgacgcgtattttgaacaccaatgcgccagaagacccaggtacgctgatcattcatgatgatgaccccgccaatgatctcaaaacaatcactggtattgctggccgtaaacattatttggtcatcacggtccgcaagtaccagctggccttgcacttagaagtcattcaacatgcgctcggggtagttgcagcgcaccatctcgttgtcgattatctgcccacgggcattgacagtttcagtctgctcattcgtgaaccgcgtcgtcaagtctcggtacaggagctgaccgctgaaatcgccgctgcctgtcaaccagacaaaatggaagtcaccgaaaatgttgcgttaatcgccatggtttctcgtaaacttcgacaacgaccagccattgccggaaaagtcctcgcttatctggatgataacctgctcaacgtacaactcgttagtcagaccaatgacgatatcaatttgctaatcggcgtacatgatcttgattacgacaaagctgttcgggtcatttatagcagtattcatcaaaactttcagcgcccggcgccttatattgaggggattgcctagcgcgttacaagtcttgaatcgcatttaataaaaaagcatcctttccgcaaaaatttactggaaaggatgcttttttgttaatctaaccttttgtcactagcaagttaacaacttataggttacttattcttttctgccatccgcgatggtgtcggttttgggtcatcatcagtggtttcctttttagggaccgttgttgcttttgctggcggcttcggtgcatctgcatgttgatccttgatggcatcgacaacgggttgattcccagcttgatgcatcaaggcgccgttcagcatcccgcgaatatcaattccggcaacttcttgcaacatgtccaattgtttgaccagtcagatcaccgtcaccataaagcttgatcgaatcgacattggcatatggactcatcgcggcttcgataatctttggcattgcctcaatggtcatcttaaaccgaccggattcgtctaactgacgggctgcttctgcttgcttggcgatagcttccgcctgcgccagcccaattgcccgcgttttgccagcttctgcttccccgatggccttagtggcattagcgttggcttcagcggctaattctacctgcttggctgatgcctcagctgccgcaatctgcgtagctttttgcgcttcagctgcgcgctgcgccttatacagatcggcgtcggcttgtttacgcacgctggcattcaattcttgctcttgtaattcagcgtctttttgggcaagttcaatatctttttctttttgaacttgcttggccttcatttgctcaacaatagcagcctgatctgcctgcgcttgggcgatttcttgctgtttcttgaaatcagccattttgacttgctgttcgcgttcggcatcagccacctgtgtctgccgctcaatttcttgttgcttagcttcttgatccgcttgcgcttgctgaatccgggtgtcacgactggccgccgcttcagccactgctgcatttttcttaacttcagcgatttgctttttacccagcgaatccagataaccgtttttatcggcaatatccttgatcgtgaatgagatgatctgcaagcccatttttgccaagtctgagctagccacatcctggactttctccgcaaaggcatcgcgattttggtacgtgtcttccacggttaaggtgcctaaaatagcgcgcagatggccttcaaggatttcggttgcttccgaattgatttgttcgtcattcttgcccagaaattgttctgccgccgtcgcgacctcttcttgactggaaccaattttcaaaataacggttccgttgacgatgattggcaccccttgttgtgtgtacacttctggggttgcgacttcaatcgtgcgcgtattcagactcaaaacatcccagcgctgcaggattggcagaatgaacgaaccgccattcgtaatcagcttaactcgattgccgttaacatctctaaaactgtgcttgcccgaaatcatggctccagagataattaacacttcgttgggcagtgcggttttgcgatgggtcgccaagaaaataaaaatcaaaatcaagacgatggccgcaatgatccacggcatataatcagttagaatttccataagtcccctcctctaaatgcgatggctaaccgcgccagttcacgctctcctaaatgcatcaacatatgcgatgccttgcttgagttcaatgatgacgaccttggtgccttgagccagtgtttgatgcgtgccggaccacaatttggcgggataggtttgccgcgccaaaccaccgccagtcaccatcacttcaccagtgtgaccatcagaaacagctaatgtaacagtccccaacaaataatcgcgatcactgacggatgtcgtgttctcaacgggtgccagtaatcgttgcaagaacgcgatcagcggcagtaagactaaagaaaaaagcatccacaataagccaatcgccaaaagcatggcaccaatgatcacaagaatttgtaaccaaaaaacttgttgggtcagccatgccaccatcgtcatcacctcactttttaatcacattaaatccctttcattttatcatgcaagccgtccataacctataccattatcgacacaacgtgcgttttttattttaacttagcgaattcttcatcccaaaccaatttagttatcaaaaaataaattttcgcaaaagatatgcctttagacgttacaaattttactgacagcattgaaccgttaaagctacagaatttcttttgttgatccaagattatgtgcattcacaaccaggctttaggcgggattgatagaaacctatcagttgtaattcaaagcatagtcttcagggtcttgataatgcagcgtcttggtgaacaagacatgactcgcataggccaacgcaatcggcaagataaagaataacaaggtcaattcaaggacattgccaactgtgacactgcccatagcatcaagcgctgccaagggaccgactaagccagaaaaaccaaaaccggcactggccggggtgccttgaatgttcaacgccgccccaataccgcctagaatgccagcattaatcgccatcggcaaaaagagctttggccgagaaagaatgttagccatctgcatttttggcgaaccgaggaagtgagccagcgacgtgccaaaagagtttgccttccagccataggtcgccaaggcaaaacctgcccccacaatcccgaggttagcagaacccgcaccgataccggtcaacgagattgccgtggcaataccgaccgtactgatcgggctcacaatcaacacggcgaaaatgatccccatgagcacacccatcacgattggctgcaaggccgtcacatcatggacaacgacaccaatatacttcgtgatgcttgaaaccggcccaagcgttaacatgccaatcccgccggcaatgaccagcaccagtgatggaatgagcaaaatcgtataagctttcaaggcgtcaccaagcagcactatcaacaaataaccaatggctaaggtgatcgcaaggttaatgacatcgccagtaccagcaaccgtcaatcctgttttagtcagatggtagttgcccgccccgacgatcgcagccaaagctaacgaactggtttgaatcggcgtaaatttggccaacatgccgacacagacagccgacagtgccggcaacaaagtcattgcagcccctgtcatgtaggtaaccaccgccaattgcggaaagcttggcagcaacagtttgacaattgcgttcaaaatagcgccgggtaccaaggcgacaataattcccacggataatccgttcaaaatgttcatagtaatggttttagcatcttgtttcattgacttgtcctccaagttagttgacttgatgcgctgacttgccgccttcaagaatggttttaacatcgtccagtgaaatatcaatcatatttttgaccgccgcatccgtataaaaaccgatatgtggtgaaatttcaacattcggcatagccttcaaagtttcaagtgcctgattatcaacgagcgtttgactgcggtcttctccgaaaataccggcttcgccttcaatcgtatccaaggctgctccggcaatcgtgtgatcattaagtgcttttatcagcgcctccgtgtcgacaatcggaccgcgtgctgcattgatcagataagcggtcggtttcattttacgtaacgcatccgcatcaatgaggtgggtggtcaagccgtccaacggtgtatggaccgtcacgacatcagatgtggtgagtaaggtgtttagatccacataactgaccgtatccgccaattcaggccgcttcactggatcactgacgatcacagtcgctcccaatgcccgaaaaatacgggccacagcactgccgattttaccagcaccaataataccgaccgtcaagttatgaatttcaggtgcttcaaggccggcccaactataatcatccttcgcttcgcgggcgcttgcttcccctaaatgccgaatcaaccgcatgacttgggctaaaaccagttcggaaaccgatcgtggcgaataggccggtacattggtcacaactaatccgtttgcagtggcggcatcaaggttcacaatatcgtaaccggtaatgcgcaatgtcagctgtttgatgccaaatgccttcagtttttggtaaaccatttcgtcaggaatcgcaccatgctgttgaatcacgacaccgtcataccccttggctaaatcaacggtgtccggtccaaattcaaccgtgttggtatcaacttgaatatcattagcagcgacccaagcatcaatcgcagcccgctcatcaggtcggacggtatacattagaatttttgtcatatttgcctccagattgttagcccagcatttttcaatcggctcattaatgcgttgccatatacttggcgatgcgctcggccgccaacttgagatccgccattgaagctgcataagaaatccgcacgtacccttcaccgccggggccaaaactagcgccaggaattaccgcgaccttcgcctcgcgcgccaaggcatagacgaacttccaactatcatgcattcgctccggcagcttggcaaaaatgtagaaagccccatctgggttcggcacagtcaaccctgcggcagttaaggctttgatcaagaagtcacggcgtttcatataagcttccttcattggctgcgtatcatccatgccgtttttcaaggcttcttcagcggcgcgctgcgcattggtggtgacactcgtgatcgtgaattcacttactttgccaatctgctgaatcacatcagctggtcctgcggtgattccgacccgccaaccggtcatggcatgggactttgagaccccattcaatacaaccgcttgatcaggtaaaatttcacccatcgacacatgtttgcctgtatacgtcagctcagagtatatttcatcactcaatacgaagatttcgtattgcttgatcaccgctgccaaggcatccaaatccgcgcgatcgtatgtcacacctgtcggattcgtcggatagttcaaaacaacggcttttaccgtgtctttgtttgcctcaattgccttctgcaacttctccggtttcaaaatgaaaccatcttctgacgtatcaataaaaatcggcttggcaccattcaacaacacaattggaatatacaacggaaaaattggcgtcgggataatgacggtatcgcctttattcagcattgccgtcaaactcgaatagataccgcctgtcgcgccagcagtgatcaaaatttggctttccgggtcatatttggtgttgtatttcgtcgccagataatggctggcagcagcccgcaatccttgaagtcctttgctttgcgtgtaatgactctcattgttttcaatcgatgcaataccggccgccttcacatgttcaggtgtcggaaaatccggctcgccaagtgtcagcttgacaataccttcaatcccgctgatcgcagcattaaattgcaaaatatcgctgggcttgagctgcttaacttcctgattcatccgatcaactaatgccatattattttcctccaatatttttccttatagttctatcataacgtgtttcatggggaagacctaggcgtccgaactttgccgccacggtcaattgtccccttcttgagaccattttgattagcgagtcactcgttctgctgcttgaagtcaaacaaaaacctcacagtcacaagccgactgtggggtaagataatgggaatgattctcctgatctcagccacacagtcaattgcttgatctgtgtgaccgctcactcaaaggtaactggtctcacagatcgtgtctgaaaaaccagaaataaaaggactgttcgctttgagtcagcttgttggtcattatgagaacctcctaagaattagattagttacaggttactgggttgtgaagcatttgtcaaatgatttatgaggtatcattagcaattcagtttttttaacgactttttgagatcactttaaaaaaggtttatcccagaaagtgctaagccaggctggaaatttcgttcaatgtctagtgcctgaccttccatatcaagaagaacagtttgttgctctgccgtgagttgatagtgatgttcacgcatctcatctctaataaagtagccgatcgaccgcacttgcgggccaatgttcatcccttgtgttcgtttacttgctagtttatcaattgcctgttttatttttaagacaatcgtttgggcggtgacatctgtttgttttccgaaaagatgttgtagttctaacatcttaaccatgattgcttgcttttcatccattcagaatcgctccttcattcgggcaacgagttgttaaatcttaacgatatacaaaatttgccttttaattgcttgccgtcttattatcgcagtatcccttccaacatctgccgactgccaattttggttatcttatccaaaatatacgcctgaggaacagttcggggttcatttaaatttaaacgtcggtattttcaggtttttcgtcgttctttcctttaattcgtataaggacaccacgaaaaaagcagttttgctaaacgtcaacaaccaacacataccctgcagaataggctacaatgaccttaattaagagaggagcatgtagtcatgaattattcaatcacacctaacagcaccttcccggttgtcaacatcacaatgggccaagatgaaacgattcaaattgaatccgggtccatgatttatcacaatggcttggtcgaactcagcggtcatatgaatagtaatggtaagaaagggcttggtggtattatgagtgctatcggccgctcagtcaccagcggcgaacgttttttcatcacaaccgccactggcactgccccggatgctgaattggccatcgcccccggtaatcctggcgttatcaaagagttaactcttgatgacacccatcaatatcgtttgaacacgggtgcttttctggccatggacaccagcgccagctatcacatggtgagtcaaaaagtcagcggtgctttgtttggtgggactggcgggttcttcattatggaaactgccggaactgggacaatgctcgtatctgcttatggtgacatcattccgatcaccttggatggcagtcatgaatatgtgattgataacagtcatgtcgttgcatgggacagcaagctaaattacaacattcaacctgccagcggtatcattggcttcacaactggtgaagggttggtcaaccgctttagtggctctggtactgtgtatattcaaacgcggaacattgaagctttggcaaatctggttcagccatttttgccaagtagcaaagactgattgaattgccctgatttaaggaaagccaatgcacatcaaaaacccgtcaatttttggcgggtttttgatgtatgcaaggaatatcaagcaaaaattgacgacactcgtgtcttgtttgccgaaaatacatgatttgactgtctacatctaaattaggcaaattcttggccattcggtagcattttccgaataccgccagcagggttaggatcatccccacggtatcgcgggatcaaatgcaggtggcaatgcatcactgtttgaccgccatacaggccgacattagcgccaacattataaccatcaggatgatattgctggtcaatcaacgttttgcctgcatgaatgagacgattgatggctaacagctcctcctcgcttaggtcgaagaagttgcttcgatgcgtccgcggaatcacaagcaagtgaccctggctcacaggatgaatatcccaaaaggccactgcgagatcattttcaagaacgatactggtttggggaagatggcaaaagatacagtcggcttgtggcatcatgatttcctttctaattaagtcttaaatcaaaaataagcacaaggcgcttgcagatctgaactgctgcatttgccttgtgcttattattcaatacgatggattatgcttcaagtttctctttacttgaatctgcaatataatgcggcacttcatcatcgatgaaatagaccttgtaccaaacaaggaaggtgtaaatcgtccaaactttccgacgatcatcgctttcctgccgatacgtacgatccaagatatcgagaatggcatcctgatcgaagaattccttgacccagtcttgttcaaacattttgcggaccgtcttgtagaacggttcgtcttccaaccactgcttgaccggcactgggaaaccgagcttttcacgactcgcccattcttccggtaagtgacggttagcagcttcacgcaatgcatacttcgagttgtgcgaattgatcagatacttggttgggataccagccgcgaccttagccacttccttatcaaggaacggtacccgcaattccatcgagttggccatcgacaacttgtcagctttcaaaagaatatcttttggcatgaactggtggatgtcgaggtactgcatcttcttaacttcatcatcgtaatgacgtacctttttgtacgaagcggtcacgatgtcacgaacactctcactttgccgaaattccggttgtaagatcttgtcagcctgaccctcatgaaaaaccagtgcttcgccgatgaaaaattcttcggcaggggctgttgattcataaagatgcaagcggccatggaaattcggcatctttttcaggccatgggcgatcgtatacttaacaccttttggcaacttgcgtaaaccgtccgcaaagactcgaatggcgtggctgcgcgtatggaagccatagttcgcataaccagcaaagagttcatcagcaccttccccagacaaaataacggtcacgtctttgtgtgccagtttcgttaggaagtatagcggtacacaggaaggattggaatctggttcatccaaatgatattgaatcaatgggaagttatctaacgcttctttttcagtaacaatatcactagtgttatccaaaccgagtttgtcactgagttccttagcggcaacgccttcgtgataccttttgttgtcaaaaccaattgagaaggtatgctctggccgcaacaaggcggtgatataagaggaatcgacccctgatgaaagtaaagacccgacttcgacatcggaaatccggtgagcatcaactgactcagaaacactcttgtcaatagctgcaacagtatcttcaaagctcaaattgttcgccttgaaatccatgtcccaatacttcttaatggttaacttgttatccttcaaggtaaaatagtgcccttcaggaatccggtaaacccctttaaagaaagtctcatccaaagccgaatattggaaagtcaaataaggcttcagtgcttccttgttcaattgtttcttaaacttaggatgcttcaaaaatgctttgatttcactacccacaataaaggtatcgccatcgtgatagtaatacattggcttgatcccaaagaaatcacgcgcgccaaacatttccttcttattatcatcccagataaggaaggcgaacatcccgcgaatcttcttgagaagttcgtccatcccatattcctcataaccgtgaagcagaacctcggtatcggaatgggttttgaacacatgcccagcagcaatcaaatccttgcgaatgctctggaagttataaatttcgccattaaagatgatcgcaactgtgccatcctcattcaggatcggctgcgaaccaccttttaagtcaatgatcgacaaccggcggaatccgagggcaacgttatcattgatatattcgccgctggaattaggaccccggtgtttgatcatgtccatcatgttattaataactggctttttatttaaaattgtcttgtccgcaaacgcgatgattccgcacatacagttaaccccttttcgcgtgaatgacgatcattacttgtttcagtataaagatttagcgtcgcaagtcaattcaagagcgtgagccaccccggttagaaaccggagtgtaagtggccttgaccgtgatggcccgggtttggccattgcggtcaaggtccttacacgcaggtttctggggtggtgatcgcgtttaaatcagagcgtgagccaccccggttagaaaccggagtgtaagtggccttggccgtgatggcccgggtttggccattgcggtcaaggtccttacacgcaggtttctggggtggcgatcgcgtttaaatcagagcgtgagcaggcccggttagaaaccggagcataagtggcctcggacataaatggctgggctttggccatttatgtccgaggtccttatatgtaggtttctgcgcctgcgattgcgtttaggtcagagcgtgagcagggccctgagccagttcgtgcgttttgaagaatagtcagcatctcattcttttcggcaagaaatcatatggtatgtgtcatcaaagactctcagtttgatattttaggtaagccttgtgagtaagcccaatttcaaaataacaatccaagtcgctactacttaaccgttttgcaaaactctttaagtttatctataaaaagttgcttttgttgaatcccaatatctaaacaaaatagtttgtacggatcgacctgtttgcgggaaagtttcagttttagtgcctccaactccttaatctcatcagttcgagtattaatttctgaggtgatcaaggccgaccttttctgctcatctaattgtgaactgtagaatagccgaaccataaagtcccattttgtttttttgctttcaactggctgttgcaaataactctcaaaggcctttttgcctttggtcgtaatcgaatagaccttcttgttcggcttccccaactgtgaaacaacttcaaacgaaacttttccttccttgtcaagtttatgcaggattggatacacactgccaaaagaagcgttataaaaatttgagaaaatagtggaaaattgatttttgatttcataaccggtggcaggtttatccactaaaatgccaagcacaatatcatcacttttcactttcatctactccttaaagaaattggtttaacaggtactagccaaaaacaaagcgcgatcaagaaaatcagcggtgttgcatattgatatagctttgtaaatgctgttacaaattgttgggcaatttctcgcttaattttgaccatcacattatttaaatcgcctactgacttgatcaccttttttgagatggtcgcttttatttggcgacggatacttgctgggagctgttcttcttgaataccctttttggttaaataagcttgatattgctgctgaatcatctcacgtttttgcttctgactgacgaccggtcccgactgcgatttagctatcccctgttgattgttcagatgtcgttttatttcgtttaatgtcttagatcgttgcgatttagagatagccgtttggcgaatttgatcttctgaaaagctcaacgccttttgtttagcatgcgatatattaactcccagcgcgctaacgaaaatggcaactgccaaaacagttccaagttgtcgcaaaacaccgataacactttgcgaagctgttaaatcgctgccttgaaaaccggccgttgatagtacgctaattgggccaactataacgccgtagcctgcgccgatcaacaaacaatacgacacatatagtaaatagtttaacgaagtaccgatagtggaaaaacctaagtagccagcccctaaggcgataaaaccaatggccagtaactttttggggttcgtttttctaacgagaaaaccagcgaggggcgataagatgaagatcatgaatgtcgctggtgtaattaatagtgccgattgaaatgctgttttatcaaagatatttgataagaaaattggcatgatgaccataaaaccgaccagaattaactgaccaaacaaggttgccactgatgctaaatcgaaattagcatttttgaacaaaccaaagttaatcatcggtacagaaacgtgtttttcccaaaaatagaataatacgccagatatgatgaaaaggctaaataaagcataaataggcaaattccatccccagaaccttagctgaatcaatgctaacgtcagtgaaacaagaccaatcactgtcagtagggagccaatccaatcaatcttagtgttttcaactggtaagttgttaggaagcgagtggatgctcattaacaaagcaataagggcaattggaatattaatcataaaaatccatcgccatcccataaactgtgtaatcaagccaccaattgtcggcccaaacgctgcggcaatcccctgtgtaatacccacaaataaagttgctttacgtttaaacaaatctgactgagtcgtaatggccagatccatgctcagtgggaaaataacagcagcaccaaaactctgaaataaccgtccaagtatcaaagaaccaacgctatggctgataccactcaacaacgaaccaagaccaaatatcactagcgcaatgatgaaaaagcgcttctttccgtaaatgttagcaagctttcctaagggaatagaggtagaggcaaaaataatcgtgtaagcatttaacgcccatgaaacgcttgttaaactcgcagacaaacttgtctgaatttccggaagagcaatgttcattatggtcgtatccagcatgactataaaaatccctagacacatcgccattaaagctgttttatttgtgtgtgaatctgtcatcaaaagtcgtctccctatgaatttaatttatatgaatacaattcataatatagacgcagctttatttttttgcaaggattgtttttcgttttcttagtgcctcgaattttttacgttagaaaaagactagccaaaacccgcgagtagagtggtatgcactctttttaacggcgataaaaatgcttcaaaaatggtagttaacaccatatcgtaatcaaagcagtcaattcatacatatatttaaagcccacaacacaaaaacgattccaaaacttctgaaacaagcagaagctttagaatcgttttaaatatgcatcatccgtatgtaatctttcaaatgacgcattgatcaaaaaccaagacatgatttcagagagcagtcagttgcctcatatgatcattccttgttttcttgaatctaatgttcttcaacactaaagaggctttaaaacgcaaaaaaacagagatccaagttcctacaggtgaacttggatctcctaagttaaggatttgaccgatgcaataatctcaaaacttttcttggtactaattgtaaaaccttcttcgataaccttaatactgcgacaccttctaaaaaatacttattcacttgtacggaacgacgagtgttgaaatgatgttgccctataactaggcgttgtttggtggtcctattgacacaccctattgaacatctatgggaagctcattgccccgcttggattactgagtctttttattagcctcgtacctccatgtgtgttcatctttggtcagttggaacatgaatcgtacgactggtggcgcagatacttactgcaccaacgctctatttgtctattcgtgctttgcgacacacacatcactttcgagctggttcgtcttggtaatgctagacaaggatcgtaatgctcggttcctgcatcgaccttttggttcttccttaacttcaattaaagtgtatcatgtaagcgctaactttgcaagctaatcacgtcatttatttaaaaaaatcgtaccatccgcgctcaatactgaaaacgccgaacacggctcgcagcaccatagccatacaagctaagcagccgctgttgcgtatccacactcaccacataaccggcatattcgctcggcaaaccaaaacgtcgatcataccggcgattaaacttggttgttagaccgtgatgacggcccatcaacgcgcttgtattctgcaggctgtaatgaatgccattaacaatgtaatctgcttctaaatgatagtgaccagctaaataaccaaccactcggccgcttgactgcctaaagtcaaaccgcagacgaccgccaaacgctggtgcctcgccagtatgcaacaccccgctcgcgtggaagttaaaggctcgcaataactcatggacagcgcggccattaaatttcagtgccggctggccattttccttcagggctggggcatggctcaacaacaagacatctcgcttaccagcaccttttaatgccaatgcaaaattccggagctgagcgaatgagaccgcaagtgttttcttgacatcaaaagccttgtgaccatcaatcaaagggacatctgccgtattcaaaacaatgatccgcaagttaggaaagtcttgaaccattagcccttcttgcgaaacagccacccctatctgctcagcatttggtctaaaaatcatcgtctggttcacttctggcaaaaagctgccgcgatgccctgcacgcttttcggcaaacttgtcattatcgtcatgattgccttttgtcacaagaaacgggacaggaccgctttgataatcagccatgatgttccgtaatcgcagtcgagtcagccatggtgcctcggacccatccaccaagtcgccaagatggacccggagtgccagtggtaattggccacttaaccattgctgttcgcgtacatgccagtaaccagtaggtccataataagtggtggcaaattttgccttatcgtgggtatccgtgatcaacgcaaagtttacggctgaaggcgacatcaatggcgagattgcggaaacaaatctggtcagatcttttttgacaaatggtcgaattgcaatgctcatgaaaacctccatcgtgatattcgggtcagatattcaagaagacgcctaatgcgagaaagacaacctgggccaacgtcgtgataaaaagattcttgatggcattcggaaaagtcagttttttaaccggattggctgcaaaaccgcgtgcgttcttcaccaccatgggtacggtgatcagggtcaacaaggttaatttcggcagtaaccccagcgcaacagcagcaatcagcatcaaaaacccaactgtatataatccatagaagaagatgatgctacgagaacggccaagataatgcacaatcgttcggcgcttgagcgtttcgtcctcttcttgatcggcaatattattggccagcaacaaggccgcaatcgtacactgtgccaatccgctggcaagataaaccgatccgatcaacggccatgagaaggcggcaacattaaagacgttgacataaacggcaattaggaaaatcacgaaacccatcgtaaatcctgagaaaaattccccatacggcgtggccgaaattggtcgcggaccgccagcataaccatagccgactgcaaagctaaacaatcccatcaccagcaagggccaccccgtgcggctcaccatccagaggcccaacacaccgctggttaccatcataccgacaaccatccacccaatcatgctcgggttgagatgatgaaccccaataatgttagtcttctcgcgaaaacgcaacgcttctgtgcgctctgatcgtttgtaatcttgataattatcgttcgcgtcaaccgccatgttaaacagcaacatggccacgaagaaaaccagtaattcagcgatatgtaacgtatgataatgataccaggaaaacaatgtgcctaataaaaacggaaaaactgaagccgttttggccttgatctcaaccaactcaagaaaaacagataaagacatgacaacctccaacaattgacttttaagaatcacatacagtagagtgaatatgtctataggaaagagagaaaatgcatgattcatccactgtggcaccgattccccatggtctatcaacaactcgaacagattcagcaacggcttgaacacgtcgctgttttgcgtgagccgcaagtccacgcattgatccagcaacagatcaacgctggcggcaaaatgctgcgcagcgggctaatgcttatgctagcgcgtttaggcaaccctgacaacgacgatctcataaccgccggcgctgccattgaggccttacatctcgcgaccttggttcacgatgatgtacttgaccacgccgacctgcgccgcggttccgataccgtctcagccaaatcaggcaatcgtgaggcaatctatgctggcgatttcctctttgccatctattttcaattattaagcgaacaaaatccagcaacaaccgatttagcgaccaatgcgcgcgtcatgaagcacatctttatgggagaagttgaccaaaatggtcccagcgcgccactcattccaagtgtttccgaatacttgaaagccatcgccggcaaaacggcagcactttttgctttggcaacttacactggtgcgacgatcggccaactagactttactgaaaaaaaggccgcatatcgttttggccgccaactaggcatggcctttcagatgattgatgacttgttggattacacccaaacaactgctacgctgaataaaccggtgctcgaagatttacataacggcattgtcacacttccgttaatttatgcctatcaaaacgtccccgaacaactcgccccactggtcgggaccgcagcaaaaatcgctgccaacagcgaccgaattgcggcaattgtcagtgaacacggcttgccccaagcccgtcaactcgccactcgctacactgataaggctatcaacgccctcgcgccattgcctgatgcgcgcattaagcaagaactacgcaagctcactcagcaattattgcgacgagatcattgatcgtctggacttcatatatgcctatcctttttgatagaaaagtaagtaccggcggataaagttcagctaacaatagaaccagcaaatctagactcagtcggctttctttgtgatcttcctaacgaaaaattaagtattaaatagcccgccacacttgttacatccggattctgcatcataccaactttttaaaaattgaaattgtaatatttcagcccgacgttttcacaaacattgggctttttcagtggtatgatgtatgtaaagcaaaagtgaaagagtgatcaaacatggcaaaagttctctccatcaacgctggcagctcctcactcaaatggaagctgttcgagatgccaagtgagcgccagcttgcagaaggcgcgactgacatcctgaaacaatcaaccgtcaagatcaagtatggtactgatcaagcttacgaaagcgctaccccaatttgcaattatcgtgacgctgttgccaacctgctctctaacctgcaaacactcggactcgttcaaaatttggatgaaattaccggcattggccatcgcgtggtagctggcggggaattattttccgccccaattgtcattgatgatcgtgttctggcgcagattcgtgctctgcgtgattatgctccgctccacaatccggttgaagccgactgtatcgccatctttcgcaaaatgatgccttgggcacttgaagtcgcagtatttgataccgcatttcatcaaaccatgaaaccagtcaattatctttacagtattccgtatgagtattatcaaaagtatggtgttcgtaaatacggtgcgcatggaaccagcgttcgctatgtgagtgctcacgccgccaaaatgcttcgcaaaccattggcacaaatgcgaatgattgtgatgcatcttggggcgggttcaagcatcacggccatccaaaacgggcaatcggttgacacatcaatgggctttacccctttgtccggtgtcacgatgggcacgcgttcaggcgatgttgatgtgtcactcatcggctatctgatgaagaaacttgccatcaccgatgtcgatcaaatgattgatatcttaaacacacagtcaggcttacgcgggatctccggcattagtcatgatgttcgcgaccttgaagccgctgcgccgactaacccgcgagccaaactggcgcttgatatctttgtgaaccgcattgttaaatatgtcggtgcttatgccgccttgatggacggtgtcgatgtcctagtcttcacagccggcatcggcgaacacagcagtgacattcgggcacgcgtcatgcaatctttagattatctcggcgcgcggattgatgcgagcttaaacactcaaatccacgataacgcaggtgacattactgcagctgattcaaaggtcaaaacactggtcatccccacaaatgaagaattgatgatcgtccgcgacgtcatgtccttaagccaagcagtggcgcaagcggaatagtggtaggcgttcgctagcccggtttctgggctggcgaacaccttatgatcgagcctgagccagacccgtcgaaaataaaattttatagtcagttctgttggcaccagcagcaaaggatcggcaatgttgtcgatccttttttttgtccaaaaataaccatgttcaactacttgccttttcttcatctgctgtctatactgtgcatatatcacatatacagtatagacacaccaaaggagatgttcgccatgctcactgtcacaggcttaacgaaacgatttggttcagcaactgctgttcacgatgtttccttcacgatccaacccggtgaaattcttggcttgattggccaaaacggcgctggtaaaacgaccacttttcgcatgctactcaatttgcttcaagctgatcacggtaatatgacttggaacgatcaaccgctatctttgctcagccgtgagacgattggttatctccccgaagaacgtggtctttatcccaaaatgaccgttgttgatcagatttgttttttcggagaattacatggcatgaaacgcgctgcggtgatggctgttctggatcgatggctggatcaatttcaggtcaaaggtaagccaaccgatttggtcaaagatctctctaaaggtaatcagcaaaaagttcaactcattgcggccatgattcacaacccgcagttcatcattttagatgagcccttttcaggcttagatccggtgaatgctggcttgcttgaagctggtattcggcggttgcgggatgctggaagtgccattatttattctagccacgacatgggcaatgttgaggccatttccgataaattggtgatgttgaaaaatggcgaagtcgttttatcaggtgctctcaatgatattcgcgatcaattcggccaaactcgcctctacattcaatctcctctcacccaagaacaattgctatccttccccggcgtggtcggtgtcgcccaacgctcccgagggtttctcgttaaattggctgagccacaagccggtcatgacattttcacagcggccacccaacaaggttatattcctgaattcagtcagcaagcaccttccctagatgaaatcttccgaatgaaagttgaggcctagtcatgaaaaaaatggatgtgattttccgccaagtcttcttcaagaatcttaaaagtaaaacctggttgtggatcgtgatcggtccgttggtgctggccgctgttttcggcggggttttttggctgatgaatcaaactaatcaaactagcaaaatcggtgtcgtgacgtccagcccagcattgaccagcacgctgaaagcaagcagtgatgatgatcaacgctacatcagctattcgtcaacggcagcggccaagcgcgcgatggctgatgaagatcttgatggggtcttgaccatcagtacgcaaccaaccacccatgccagcctcattgaacgaactgatggcaatggtgtcaaccaaacccaactgcaaagcatcttagcacaggcacatactaaagaagttgcggctcagttgaaattatcgactacgcaactgcaaagtcttttcgcgacaccccagctggccaccaccagtgtctccgttgataaaggaaaacttgtcagccggtctgccaaaactcaaaaatcaggcgccatggtcgggtttattctcggcatgctgatatatacctttgtcattagctacgcttccatgatggcacaggaaatcggcactgaaaaaggctcccgcattgaggaatccatcctcactgccatcacgccgcaagcacagttttttggtaaactgctgggtattttagccttgatggccgtccaaatggcgatctacggcgttgtgacgcttgctggtggtctcttactgcaacatttaccgaagaatccgctatccagtttgatgacgaacattgatctcagcggtatcagcttaaatatgctgattttcagtctcgctttcttttttgtcggcacgctcacttacaccgttttagctgccttaactggctcattggttgctaatcaagaacaaatcggccaagccacgaccccaatcgttatgctgggaatgctaggctacttcggcgctttgattgttgctggcggaacctcaccaatccttaacatcgccagctacatccccttcctatcgaccatgatgatgccggttcgcctaggcgcaggacaggtcactgctgttgccgggtggtcagcattaggcatcaatctcgttttcctaatcttattcacttggctcaccgtcaaattttaccagaccaatgtgttaagctattcagatggcggcatgttgaaagctttcaaacgctcatggcaactacaacgcgccgcccgcaaacctaaacctgttaaatcatgaaacgaggttaaccatgcggatcgttatttcgaatcaatccggcaaaccgatttatgagcaaattgaagatcagatcaagactgcgattctttctggtcaattaaaggtgaatgaacaactgccatcaattcgcagtctggcaaaagatttacggatcagtgtgatcaccaccacccgcgcttatcacgaactcgaagcagccggattcattacgaatgtgcaaggcaaaggcgcctatgttttgggtcaagacagtgcacttgtgaaggaaaacgctttgcgtgaaattgagacctatctgaatcaagccatcgatactgccaaaatggcgcgcattgcacctgaagaactacacacgatgttggatacattgatgcacacggagggagacactgacaatgacaactgatctgctaaccgttacgaacttgaccaaacgctatgccgattatcaacttgctaatgtcagttttagtttacctgctggctacatcatgggcttcattggtcccaatggtgcaggcaaaacgaccacaatcaaagccattttggatatgatcaaaccagactcaggtaacatttcggtacttggtcaaaccacgccacaagcccgcgaagcgattcgcgatcaacttgggattgttttagatggcgcggtttatcctgactcatggccagcagaagctgtcaatcgttatgttggaccgtttttccctaattgggacacggcttatttccagcaactgctgcgtgactttgatattccaaccaagcctaagtatcacgatttatcgatgggcaccaaaatcaagttacagttagcggccgctttggcacatcatcctaagctcttgatcctagatgagcccacttctggcttagatccgattgcgcgtgatgagttgattgccattctgcaagattttattcgcgatgagcaacacagcgttcttatttcgacacacagcatcatggagctcgctaaagtggcggattatgtcacttatctgttggctggtaaaatcacgttcactggtccactcagcgatctccttgaccgctatcttttgattaaaggcggaccgaacgatttgactgctgcaatcaaagccaccttaattgggttgcaggaaagtccggtcggtttctccggtgtatggccagctgaccaagcagcaatgttgcccgacaacatgattcaggaacctgtcgatttagaaacattgatgatcgcgtttggtaaaggagggcatccccatgcgtaatgttaccaaacttgtcgccttagacatgggtgcgctttactccggcacgcataaataccgctggtggtcatatctggttgcttttctgatcgtggccattgccttcttgaatggtgatgccgccacaccacttgctggcgctatcaccggtactagcgttggtatcttgatgatgccgtttgccagtgttgatcgacatggcttggaacagttgtacacgatgctgcctatccgccgccgagagattgtcgccagtcactacctatttggcttgctcgtcatgctgatgattgatctttatgccgcattcatcgttgcagtcggcatgatcgctcgtttcaacccgatatatgactaccatgccattatctggatgctatttttcgcaaccggccttgtcttattacaaatgacattgtcgtttcctctaatgattgggcttggcttccaacgtgccccgttagctgcttatttaccgattggcattgtgttactcgccgtttttattgaagccggcttagaccttgacttagcagtcttgcggccctggctcacggcgttctccatacttttgatcgtcgcctttgcgttttcttggtggctgagtacctatctatataaaaggcgcgaattttaacctttaaaaaccaaaaagccgtcaccttgctgcttagagcaagatgacggctttttggttgctttattcagttggcaaacaagcaaggctcgtgcatgaatcacgcctcaaccttgaccatctttaaatgccggatataaagtcatcccgccatcaatgaataaggtaatgccagtcacataactggattcgctggatgccagccatgctgcaccagctgacacatcttcaggtttgccaattcgattcatcggtaccattgaaactgtctggtcatactgcgccttgtcagcaaatttctcggcgttaatcggcatttcaatcgcaccagggccaattgcattgacccgaatcccttgcttagcatattccatcgcaatcgtctgggtaaaaagtttgactgcacctttggccgccgcataactcgcgaaggttggccacggaatttgttcatgcaccgaggtgatattaataatgttgcctgcctgatggtgttcaagaaaatagttcagtgcagcccgcgctcctaaaaagacgccggtttgattaatggcaatcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggtttacttttgccatgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggccttgatttccatgccagcgttattcacccagacatcaagtccgccaaaatgagccgttgctgtctcaactaagctagcaatgccatcttctgtggaaacgtcagcatggatgctcaccgcctgcccgccatttttgatcacggtgtcggcgacttgctttgcaccttcatgatcacctaaataattgatcacgactgacatgtgctctttgccaaatcgttctgcaatggcagcgccgatgccttttgaaccacccgtcacaattgcaatctttccgttcaagtcttgatacatgctcgctcttcctctcatgcgtgtggtcacgcagcggtcacctagaaggtaggccctaaattcagtgtaggggtatggtattagattgtaaaacattgtgctgcactaggatgccttttcaaaagaaatctcaaattccgtctaaaaaagccaaaataaatcaaaaacgatttatgagaatcatccattatttgtaaacacgtgtcttttaggcatttgggattaaatacgcgcaaatattattttgaaacaataaaaaaggctctgtatctttctcttctcaaaaaaaccttatcaagaccgattaaagttcccccgaattattgagattttagtacttagaattaaagagttctaaaatcattatccaaagttcacttggtcacaagtcttttatgcctcttttgcgtcaacaatgtttgatatttaagaccaatattcttctttatacatgttctttaactaccggcgtatagaggatgaattaagtatccggtgagaaataatcggtaaaactgtaagcgggtacattttatatgtgagaaatatcacacagttgttgtgctacttgttgtgaaggccttaacattgctggtggaaagaaaggactgattgttgtgaaagttggcgttgtgaaagagcaaaaagctggcgaaggtcgtgtggctgtcacaccagaaaatgttaaaaagctggttgatgcaggagcgactgttttggttgaaaaatcagctggagtcggtgcaggttttcctgatgctgattacgctgcggctggcggcactatcgtcagtcacgctcagagttgggatagtgatctcgttgtcaaagtcaaagaacctgacgaggaagaatatcagtatttcaaaccaggtcaggtcgtctggggattccaacatttggcctcctcacctgccactgtgaaagccatgcaagctgccggcacgacagcgatcggcggtgaaaccatcgttgaaaatggcgagttggcattgctaaaaccgatgagcgctatcgcaggtcgccggtccgtcatcatgggcgcttattatcttgaagcacagcatggcggtgaaggcattttattgccaggcacaccggaagttgcttcaggcacggtggttattttcggtggtgggaacgctgcttttaacgccgccagtttggcattagccatgggctgtcgtgtcacaatcatcgaacttaaaaaagaccgccgtgactggttagcgaagcagtttacaggtgaagccctgacgctcctgccatcgacgccagagaatctcgccgcggctatcaagaccgccgatgtcttcatctcaaccattctgattccgggcgcaaagccgccgaagttagtcacaacagcgatggtacagtcgatgaaaccgggcagtgtccttgtagatgtagccattgatcaaggcggcacggttgaaactattgatgcaccaacctctattgatgatccggttttcaccaaatacgacgtcattcattatgccgtgccaaatcaaccaggcgcggtaccgcgcacagcaacgatggcactggcagttggcaacatcaagtatcttttggcaatcgctaagtctggaattgatgccgccatcaaaaatgatcctgcgctggcttctggcgtcaatctttatcacggccaagttaccaacaaaggccttgccgaatcattaaacttaccggttgtttcattagaaacagcgctcaaaacgcaacattaggaggtggataagatgatgaccgcaacgcaaaccgtgagtataaaagatgttcaagaggctagccatctcattcatgaggttggccgagtcacaccgctcattcaatccatgtttcttagtcgcaccgttacccatggtgatgtgtatctcaaactggaaaacatgcagctcacaggttcatttaagtttcgcggtgcttataacaaaatccgccatctcagtgacgccgaaaaagctcgtggtgtcatcacggccagtgctggcaatcatgcccaaggcgttgcattgacggctcacttactcgacattgatgcgacagttgtgatgcctaaaacagcgccattagccaaacaacaagccacgagcggctatggtgcaaaagttgtccttgccggtgatacttttgacgaatctcgtgccttcatggaacaaaaggccaaggaagatggcttaaccatcgttgacccctacaatgatccattggtcattgccggacaaggctccatcggcttagagattttagatcagctgtgggatgttgataccgtcatcgtaccagttggcggtggtggcctgattacggggattgccaccgttctgaaacattttaatccctatattcacatcgttggtgtccaatcagaaaatgtccacggtatgacggcctcgttgcaagcaggcaagttgacccgacaatgtactggcccgaccctagctgacggcacagcggtcgccatgcccggcgatatcacctttggcctagctgaggaattagtcgatgagatggtactcgtctcagaagaagaaattgctgaagcgatgaaagaccttctccaacgcaccaaaaccgtggcagaaggcgccggtgcattaccaacagcggccctcgaggctcacaaaatcgcaccgcaatggctagcaggcaagaaagttgttgcacttgtctctggtggcaacgtcgatttggaacgggtagcagataacattgatcatttctttaaaagtgatccgactgggcacttcatcggataaaaacagagcatgagctagcgcggtttctgggctagctcatgctctcaccataacgcgataacgcgctcgccagcgctggctcgcgctcactttcaaaagggggggaagcaccatggaaaagacgttttcgaagcataccgttgccaagacacattatgtgccatacgcaacggatggtgccaaggaaaatagcggcggcagcacagcgatcatgatcatgggcgccattttggcaacgatcttcgcagcatctaccgcttattcaggcatgaaagccggcctaactgttgctgctgggattcccggttcgattatcggttccggcatggtcggtgtctttgccaaaaagaaaggtatttttggcaaaaatcttttgcaaggcatgagctcaggtggtgaatccatcgccagcggcatgatctatgtcttgccagccattatcattattggtggaaaagtcaacttcttcgcaggcatcgcagttggcgctttggccgtattgtttgctgtcggtgttgcaagtttagttgaaaactacctacttgtcgaagaaaacggcaagctgatgtacccagaatcgacggctatctccgaagccttagacgccagtgaagcaggcggtgattcgcttaaacatatgggcatcggctttgggatcggcggtatcatcactttgttgaccactcaggttttcggctgggtgaacagtgtgatgaccttcgtcggcaactcgtcgtatcgctggaaaatttcaacagaggtcaatcccatgctagccggcatcggctttgtcgttggcttggatgtttcgctcaccatgttcgcaggctccattttagcgaacttcgggatcaccccgctcatcgcttatttcactcaaatggctggtggcggtgcccatgtttggaatgacacccatatgttgatgtctcaaatgaacatcgacatggtcgctggctcctataccaagtacatcggcgccggaatgatgctctgcggtgggatcattggcgccattaaattgattcctgtcattgtcacttccattaaaaaaacattgaatgcacgcaatgatgtcggcgaagaaaagaattcgctcggtgtggtctccctacttgttgctgccatcgcgatcttcatcgtcggtgctttcttagctggcaacatcgtgatcgctatcatcgccggtattttgtcactcgttttagctttgctgtttgtcatcgtttcggcgcgactggctggcacaattggttgttccaatgcgcctgtatcggggatgaccattgcaagtctcgtggtcatgaccctcgtgtttgccttaatgggctggaccgccaacgcgcataatgaaatccttttgctctttggtgtcttcattgtcaccgccatttcagtcggcggggcctatacccaaacgcaaaaagttaattatttggtcggtggccgccgctccgaaatgatgaagtatttcatgattgctgccttgatcggagttattgttgtcgttggtacaaccgtcatcctcgcaccgcaactggccattaagagtgctaacccgccattcggtttaccacaagctaacctgattgcgaccctaactactgggattctctccggtaatctaccgtggatcatgatcatcgtcggtatcatcattgcgattgtctgctggatgcttggtctctccatcatgaccgttgccttaggtttctacctgccaatctccacgacatccattatcctcgtgggggccttgctcaaattattgatcgaaaaactgacaaaagacaaggccttacgcgaaacccggttatcctccggtgtctcgctttccagcggtttaatcgcgggcggttccatcattggtctgatcgggattatcctgcatgtcactggtgtgttatccaatcgtgttcctgcaggctttgctggcagtaatgggatggctgtcatcttgctcatcatcatggcggcaaccatcgtcatcccactgatgcgaatcaaacaaccagcgcgcaaggctcaaaagcaataaagaggtgtgacacatgactgcgactgacacattacaacatttgatttatgaaaaaaatccagcaattcagtacactaaaaaaggcggaaaaatcacgattatccgtccgcagaatcacccaatccaaaaattctgtcggcattatctgcacatgaagattcctgccgtcagttacctacacttagatgcatacggtagttttgtattcagcaagatcaatggtcatcgcagcgccgccgttattggcaaagaactagccaagaaattccctgaagcagacgatcaccgcgatgaccgcctgatgatctatttgaaccaaattgccaaaaatgaccaccttattcagcgtctcaacgcaaatacacgataacgcgctcgcagtcgcagaaacctgtgcataaggaacttgaatccaatggccaagtttgggccatttggattcaagcccgcttatgctccggtttctaaatgctcctgctcgcgctcaactattggaggaaatcaacatgattgatcgtattgaaatttcagcttgcacatccatgatggtcggtaaaaaagcatcccttgacggcgcgacctacatctcccgcaacgaggatcgcttagtcgcaatctatccaaaacgttttgtggttcaaccagctgtaactggccgcaaggaaacttatgtatcgccatataacaacctgactgtgccactccccgaatccgggtatcgttacacatccacgcccgatgctgaccaaagcgccgggccaaatgaagaagacggttttaatgaaaagaatgtcggcgaaagtgctaccgaaagtgtttatgccaacgaacgggtacttgcttatgatcccttcatcaaaaatggactcgcggaagactccatgacaactttagtgttaccgtttatcaacagtgcccgcgatggcgtccggtatctcggcgaactggtcaaaaagtacggttcagctgaaggcaatggtgtccaatttaacgatcaagacgaagtttggtatatggaaattgtcaccggtcatcaatgggtggcggttcgcattcctgacgattgttacgcagttgctgccaaccaaatcgcgattcaggacattgatttcaatgatccagacaactatatgtgggcagatggcattcaagatttcgtcaaagatcacaacttgaatcctgacgccgatcactggaacttccggcacatttttggcaccgacactgaaaaggatcaccactacaatacaccacgggtttggttcgcccaacgctaccttaatccagaaattgagcaggatccggaatcagctgaattgccattcattcgcaaggccaaccgcaaaatttccgttgaagatattcagtacattatgaaatcccacttcaatgaaaccaaatttgatccgttgggtcacggcaatgaacacgaccgcaagacttatcgcgctatctcactttcgcgcacggccaactcgcatattctgcaaatgcgtgatgccaatcaaaatggcgcagccggcgtccaatgggtcggcttcggtatcccggccttttgcccgcacgtaccgtttttcaccaatgcaaccgatacggataaaagttatagcgagttcccaaagaagatggatctgagctcagcttattggctctatgaagcgctcgcgatggttgtcgaatcgcattatgctgagttcatcgaagacgacctagcttatcaaaaagatctcaatgaatgggcacgtcgtaaaattgctgaagttgatcaagctgccgccgggatgagtggcgatgacttaaccacgtatctgactgaacaaaatcatgccattgccaagcactacaatgacacaacccgtgatttcctgttcaagctcatcacaatgggcactaacttatcgaagctcaccttcaagatggatcctaatttgtaggcaagtttaccaacattcaaaaagacatcgccgcagcagttcctgcaaaagcgatgtctttttgaatgccgcttatttgttaaaaaattgccgctacagcctcaccgaatcttatgccaagctgcagcactttcagaagggaaaatatgggccatttgccacatttgttgcttactgaagtggaagacaattgctggtaataaggtgttgatcgcatcttccgcttgggcactgaattcagttgcgccaaccaaatgatgatcccgatcaaagatgaggatgctatcccccatcgtttcctgatcggtttgatggtaccagtcatcgggaatatgattgcgaacaacttggtaagcgccatcagcagcttcttctggcgtcacaccaactttcgcaattcgcggagttgtgtacacagtcgatggtatcgctggatagtcaatggggtcggttgtctggccgctgagcaactgatacaggtaataggattcgaaagtggccgttggagtcaacttgggttgcggcttgtcgagcacatccccggacgcgaaaatgttcggcacattcgtccgcaaatgatcgtcaaccgggatgccgcgttgactaaaggtgacacctgcagcttctaacccaatttgatcatcattaggaattcgaccagttgcatctaacgcccagtcaacttgttgttcctgatgatcgccatattggatcgcaatgccttgcgccgtctgtttcaatgcctgcacgtctgcactggggataaacttgacgcctcttttggtcatgtctgccatcaccgctttgacaaatggctggtgaaattcgcgcaacgctttgtctgcatgcatgaagacgctgacttcagctccggcagcattggcaatcgtcgcaaattccatactgatgtaacctgatcccaaaatgccgattcgttttggcaatgttttcaagtccatgaacgcgcgactatcatgtgctaattcagttccggggatgtcgaggtgatgcggacggcggccagtagcgatgaccatgttttcggccgtataagttttgccagcaactgtgatactatgcggatcaatgaatttcccatgcccgtgaatgatcgtcacgccggtttgtttgagattactggagatatttgtcggcagcggtttgatcactgcttgtttatgtgccactagctccgaccagttaatcgtgatgctgccggacacgatgccttgcatgcgttcggccatacgttgcaacacgactggtgtgtccagcgtgatttttgcgttacacccataattagggcaagtgccgccaatcatgtcgctttcgatcacgccaactttctttcctgaagccgctaacggtccagcaccatcgaacgcgccgtgaccactacctaagtacaagacatcaaaatcgtattcactcatattgatcctccttgtgcagtgcgtctgtgacaacggcttaagcataacagattgacgacgactcggtcacggacaatgaactttattttctgataaactgctcctagctcataaaccaaaaagaccaacaatttcccgctgtacagggaaattgttggcttggttgatggctattaatgaagtcccgttctgtttctgatactaattaaaggtcgcgacttgcctgtggttttttgacttggaaggcaacgatgagtccgataatggctaggatcaagacgaacataaagccaaaatgcgaaccaattgtcaggccagtttgtccagcggctttggccgaaccgagcgcgagcatacttgtggcaacagcagttgaaacggcgccgacaatttgctgcagtgtgttcagcaaggcactgccgtctgcgctttcggcaccgctcaaactattcagcccatatgtctgggcaggtgacatcgctaacggcgcgccgatcattaagacaacatgccctaaaataatccaccataacggactttgtgcaccactattaagcaatatcaacacgcctaggatagcaatggcaaaaccaccgcgggataaccatttagcaccgtggctgtcatacatccgacctgcaatcgcagaaacagcagcgttcacaatcccgcctggtaacatgacaagtccggtcatggcaactggcaggcccatcacccgttgcagatacatcggcagtaaatacatcgaggccagaatcaccccaaaatcaagcatgacgagtaacgttccgacagtaaactgtttattagcaaaaacgcgtaaattcagcatcgggtttgttaacgataattgccgccgggcataaagaactaaaccgataaccccaacgagcaaagcaagtccgacttccagcgaaagccagccagcatcactcgccatcgttgtcccaaccacaatcccagcaaagccaatcgacgattcaacaattgacaaccagtagactggtgtttgcgtttgatgataaacattttccatcgaagttaatgtgaaaatgaaagccaaaaccaagaatggcacgaatagccaaaaaatatagtgccaagtgaatttggcaagcaccagcccggtaatcgttgggccaatagcaggcgcaaacataatcaccaaagcagccatccccatgactgtccctaatttatatggcgggaaaatctgcatggcgactgaaaacatcagcggcaaaatcagccccgtgccaatgccttgaatcaatcgcccaataagcacaaccggaaaaacagcgcccatcgcagacacaaccgagcccagaataaaggcgccaagtgcaaaaagaatgatctttttagtgttaaaccattttgataaaaggctggataacggcatgcagatcccgataaccaacatataacctgtgactagccactgaatagtgccttgtgacacattcaacgccgtcattaaactaggcaacgcaatattaagcgacgtctctgaaaacataccgacaaacgccccaatcatcaagccgatcatggccattgctggatgggctacgtgaacgcgagcttgcggcatttcttttgtttgtgataattgcatgataacttcctttttagtgagcgcgagcgggagcgtttaggaaccggagcataagcgggcttaagattaactggctggtctttggccagttaatcttaaggtccttatgtgtaggtttctgcgactgcgagcgcgttatagtgagcgcgagccagcgcggttagcaaccggagtgtaagtggccttgggcgtgatggtcgcactttgaccattgcgaccaaggtccttacacgcaggttgctgcgctggcgaacgcgttaaatgataaaaacaaacaactggcattggctttatgcggccaatgccagcttgatcaagcgggtcagttgatccgcggtctgtcgcaacaagtcaggattgtctttggttgcggcaagaataatggcgccctcaatgctggcttgaataaattggccaagtggctgggcacggtcaggcggaataccggctgacgtgagccttttgatgtacagcgtttctaactgggtaaaaacagcgctgcaagcggcctgcaactcaggatcatcgcctgtttctaaggctattaagctaattgaattgccaccaagatgccccttttcctgcatttcggtcgccatactttctagttgtccagccagcgcagcgtcaggcgccttataccgatcaaggtcccgttgcacatgctcaagaatgtgctggccagcataagtaatcgcagcttcaatcaattgcgctttaccgtttggaaaataataataaagtgagccctttggtgtaccactgaccgttaaaatctgcgccaaaccagtagctctgaccccttctttttgaaagagactggcagccgttgccaccagtttttcgcgtgtatccatttgctacctccactattataacaaccggtctatataatactgcttattttctgaaaatgtcaattttatttttttatgcatgaaaaaatgaccttctcatcagaaggtcactttgcaaaacgattattaacctaaatccgttccattggaagcaatcacccgctgataccagttaaacgattgctttttgtaacggtttaaactgccttgcccagcatcgtccagatcgacatagatgaaaccgtaacgtttcgacatttggcctgaagaagcactgaccagatcaatgcagccccatggcgtatagcccatcagatccacgccatcatgaatggccgcacccatttgttcaatatgctgcttcaagtaatcaatccgataatcatccttgattttgccatcagcatccggtttgtcaacgacgccaagtccattttcaacaatgaaaagtggtttacggtaacgttcatataattgatttaacgcgatgcgcagaccaatcggatcaatctgccagccccattcactcgccttcaaaaacggatttttgatgccactaagcaggttgcccccgacttcagcatgttctttttcaactgtttcgactacggcggacatatagtagctaaaaccaatgtagtcaaccggatgatttttcagcagtgttaattcctcggctgaaaaatcaagatctgtgaatttaaacccgttgtccgccatcaacgcgtcggtataggctgggtactcgccgcgaacctgcacatcgccgcaaaagaaattaaatgcctgattttgctgcaaggtcgccaattgattcactgggttggcatcatagctgtaagtggtggcataaagcaacatgcagccaacttgaagtttaggatcaagcgcatgtccgattttcacggcccaagcgctggcaacaaactgattgtgccatgcttgaaaaattgtttgcttgtcattgccgccattattggcaaccaatccttggctcatcaccggaaatgcccatgcactgttaatttcattaaacgtcatccaatactttacttgcttaaagtagcgagtcaaaactgtttccgcaaaatgcttataaaactcgataagacgtttatttttccagccgccatatttggtcaccagatgcaacggcatttcgtaatgtgaaatcgtgacaactggttcgatatcgtatttcaagcatgtcgcaataacctcatcataaaatttcaagcccgaggcatttggtgttttctcatcaccttctgggaaaatccgtgaccacgcaatcgaaaaacgatagcatttaaatcccatctcgctgaaaagtttgatgtcttctttaaaccgatgataatgatcaatgccttgatggtttgggtagcgatacttgcttttgtcgatggtccagttgaaatctggccgattcacaattgcaaaacgatccttgccttgtggtagcacatcggcgactgaaaggcctttgccatcttcctgataagctccttcaagttgattggctgccgtagcaccgccccataaaaaattcttcggaaaatttaggtatgtcattggtctgctctccttaaacacgctcccagccgcagaaaccgcgtctactcacgctcttttaaaacgccttcactggcgcagcgcggctatgtgaagaacattaaaggcaaccagccgatcacccttaatgccgcttcgctacgccgcgcttaccgcgccagttcacgctctttacgctaatgtcatgaccggccgatcatcggtggctccttgtccaagcgtcgcgatttgatactggtcggaattggtcacaatcatcatcacggtactttcatacccttctttttcaatggcttcgtgatcgaattgcaccaacggcgttccaatttcaacgtgctgtccttgtgccacaagtggttgaaaatgtttgccttttagattaaccgtatcgataccgatatgaatcaaaatttccgagcctttgtccgactgaatcccaatcgcatgaccggttggataaagcagtctaatcacgccagcaacaggtgccttcaccatgccgttttcaggaacgattgccacacctttgcccatggtctcagatgcaaagacctcatctgccaagccggttaacggcacaagcactcctttgactggtgctgctaacgcttcgcctagttcgctgttggcagaaggcgctgttttggtttttgcgcctgcgttgataccgccaaagaagtaagtgagcaccgtcccgagcgcgaacgcgaccacatcgccaaccacagaaagtccaaagcctttgccaataaaagttggcagtgaaagcacactggccaaagcagcggcatttgccccggcaccggaaatcgcaacgatcataccgccgactgctcctgccacacaggcaagataaaatggctttttcaacttcaatgtaatcccataaattgtcggttctgtgatcccgaatagtgcggtaatggtactggaaccggcaagacttttcattttggcatcacgcgttctaagaaataccgccagtgctgcaccagcttgagacagcactgctgggagcagaatcggcatcatcaaatcggttccattctgagcaatattgttcatcatcaccggtaccagtgcccagtgaacgccgaaaatcacgatcacttgccagaaaccgccgagcactaaaccagccaaaattggcacactcttgttcaacgacacaatcgctgttgccaaccaactgctgaccgtcgcactgatgggcccaaccacaatcagcgtcaatggcacaatgacaaccaaaagacaaactggcgccaaaatgttacgaacggattcgtgccacaacttgttgaaaactggttctaagaatttctgaacaacaacaaccagcagaattggcaagactgtcgcggtataattcgccggcacgactggaataccgaaaaagtcaatagttgttgcctttgcgcccaacgcgacaatgcccggcgacaccatcgccgccgcaatcgccatggatacaaattgattgactttgagttgttttgcagcggtaaacgctaaggcaattggcaggaaatagaaaataccatctgctgcggcccaccaaatttgatacgcgccgcttttcgctgttaaccagcccatgaccacggccagtgatagcaagcctttcaaaatccctgcaccggccatcgcgcccaagaatggcgtaaaaacgccagaaatgaacgttagcaagctgttgaaagcgcttttgaacgtcatttttccttgtacggctgtttcaccgctagtttcgccttcgcttaaagatggttccagtttcacgacttcatggtaaacatccccgacattgttaccaatcacgacttgaaactgaccactggcttcaaccacggtgatcacaccatccaacgcctcgattttatctttgggtacttttgcacgatccttcaatgtaaaacgcagacgagtggcacagtgccagacctgattgatgttttgtttgccaccaatcagatttaataattgctgagctaatcctgattcattcattcggccttccccctttagctacacatagctacacttgcgatttccacagcgagtgatatggttcaatatcttgcatcacgatgactgcacttcgctgtctggtgttgcattctttcttaaacgcgatcgctagcctacttagtggctgttgaactaggccaccatatcttcgacccttgtagtaaatttatagcgaatttgataggcctcaccctcgaatttagccaaaattaaaattggtatagcaaatacccttaacagggtcagcacattgctcaagacgatggccgcgtcaatcttgacggccagtgattcagctgtccgagtgttcaccaagccaagccccagcgtgcccttcataaaagcaaaccggcgttcaatggtacctcttcgattctcggcatcagtatcctcacgccgtttcgctgcatcaacgtgttttggatgccggccaagcttcggaccgcagattcggatacccaaatccttacacagctttaggttctcccgattacggtacagcgtatcggccagtacttcatccggataatgtccatgaaggtcgtaatagtggtctaaagtttccgcgaagtcttggccctcagagaatgcggtgaaatcaaaacgttcaatgtcgactacgccttcacttaacgaacagtcaatcttcgccccaaattcaactttagcattggccttaccacgttgaattgggcgaatgtacggctgttggagactaacaattcggtcttcaacgtggtgagtcttgtgggtatacatgtaccattgctggtcaaatagaattcgaatcacgcctaagcgaatcgcttgttcatctggtagagtcgcaccctgatcgatgaattcgttgatgtaccgcaaatcacggcgcacatattgaagttgggccttgacctgtttatgaaagccaccacgctgttgctttggatgtcgtgaaaatgaggtccaacaatgcttcgcctcgcgtttgtacatgcgtgggtttggcacaccaagttggtgtgccatatcgatcgccatcgcctcaagattcagccttgcttggttgaggaggacggtgtcttgaggatacttgattttgactggcactgcggttgcgtccgtgatgacggtgtccactttgaatgggaccaacgcttcgatcttggcgcgtactgtatcattcatgatattcgtaatcagctcggagatatcggcaattcgtttgcgaaagtgtgccaggctggaataattgaacggctcaaccgctttgtattcggacaacccgatgaaatattgaagtgcgggtgtatcacgaattgccgcaaccaccccacgatcagttaaacccatccgttgttggatcaggattgccccatagagtaaacgaaatggttttgccgcacgtcccgcatttttggtgaactccaattggtatgcctcatcgagagctttccagggcatgacctccgccaactggatccactcattgttagagctaagtggggtacttaaaccggcaccaaaggattcaaatgacaattgaagcgggctgtgacgatagaccatacgataacctccgagtaggttcccaaaaaatgcaaggaaaatgcaggaaaacagctaattccaatggatttattataccgcaataatgcatatattagcttaactgcctgaattatagaatttttaagcagccactacttacactccggtttctaaccgtgctagctcacgttctttctcaaaacgcgttcgctggcgcagaagcctgcacataaggacctgaagcctaaatggtccaagcccaaccatttaggcttcaggccgcttatgctccggtttctaaccgcgccagctcacgctccacaaaaaaagccagaaagaccggacttgtggtgtacaagtcgtgtctttctggttttgcctaatccaatagttacaagccagatggttctgtattcgctttcaacgacaccatcttatcgtacgcattagcacgcgtcaacaacttttttcactccgccaaactttttgctaagcgcgcaatatgcatggtgagatagatttgctcgtttttaggaatcgcaatcgctaacttctgtcgcatgaatcggtcaacgtcttccatacagtgataagcacgggcataatcctattgaagatgtttcaacaagacatagtcgtagttttccatctttaacgacaaaggtgacggtgcagcagcatacatgcgttgtaagaaaaatttgaggtgaataactagtcgctgataatcaggtgttttgacgttcatgtccagccctagattgtaaaagattattttcgtgagactcgccatggtttgggtaaaggcgagtgagttaacagtttgttgatgattcaggtcgttgctcacaaactttaacgcgatgaatcccgcctcatcttccggcaattgttcatgcaattgcgcggcgatttgatgcaatgcccattcgcccatctcgtattcttgggtgtaggcaacctgaatctcccatagcaatttgttgtgcaatacgatcttctcatgcagccgttgcaccgcaaaatgaacatgatcggctagctcaatcaacagataactgttgaacgtggtttgcaatcgcttttctgcctcctgaatgatcccagcggccaaatccaaataagcactgggcagactggcaatcgtcgccgtcgcgattttcagctttgcttgatcctctggcacatagactttcatactgtcgcgcaaggccatcttggcgtcttttttagcgcggaaaccgatcccacgctcgaccacgatcacctcgcgttgttgatgtctggccacgacagcattgttgttcagcacgttttgaataatcatggcgaccctccccaaaaggtattcgaatcttcactttgtcgtattctcaaaatagcgtaacaatgattttaaaaattgacaacgtgaacgactcagccgccgaaaatatcgacattcaggggggatctttatgcctgttatttaggctcggtgctggcagctgaaacccgatgatccgcaaatcgatacagccgatcagcataagccgccgactctgcacgatgcgaaatcatgatcacgatgccgtgataataagccttgatagtgtccaaaactaatcgctcgttttcagtatcaagattgctcgttggttcatccagcaccaaaacgctgcttgggtgtaacaaggctctggccaattccagccgttgttgttccccactagaaaattgcaattgtcctgatacgacattttcatcaagccccttttcggcctgacgcaaccgcgacgtcagcttgacttgatcaagcacggtccagatttgcgcatctgtgatcgtcgaatcgtgcaacgtgagattgtcacgcaccgactcagagaaaaagactggcgtttgtggcaaataattcacctgcgcgcgcagtgatgctggatcaattttggtcaggtcaatgccatcaattaaaattcggccttgggtgagcggataccaacccatgatcaatttggccaatgtactttttccagacccactggcgccgacaaaaccgacaatctcgccggcatgcaaggacaacgacacttgtcgcaaaacgatctcgtcacggctaggatacttaaaggtgacgtgatcagcttgaatggtcgcgatttgattcagtgtttgggtagcgtcaatcgccgctgatgttgctggcgcctcttgcaaaagattcaataaattgcgagcagccgcaaaaccattcaatagcgaggctggcaaattggttaaagctaataacggtccgaacgtgagcggaaacacggccaataacgcttgctgcaatggctgcggctgagtccaaccgctcaaccacacaatgaatagccacgctaccagcatcaccaacgtagcactcatatttttcaataattgaccaaactgggattgttgaaaggcggtcgcctcatgatcaaatccctcattgcctgttttcatgcgcgcatcagcaacctctaactgacgcaaaaccgccatgccgcgaacggattcaagcagatactgctgattaaccgctttttgacgatccgcagcctgagccttcgccgtcatctgctcgtgccgataatacggaattaacagcccgacagccgcatagctcaccaacacaacggccgccgccggaccatttaagctgctataaacggcaaccatcaggacaccataaataaggccaatcgcaaccggaacaatcgtatgtgcgtagaaaatttccattgcctcaatgtcactgccaatcagtttaagcaacttgccgctgccttggctatcaagtttagcgggcgccaactgcaccaattttcgataaaccgcaccgcgcaattcggccaagacgtgaaacgccacaaaatggccagcatattgttcaccaaaactacccagaccaacaatcaccaccgcgatgatgccggggattaaaaggtgtgaggcattctggggatcgaacaacatcatcgcagccaaaactaaaacgacgacttttgttaattcggcaaccaagccaatcagaaaactgatgataatagcccccgttaagtggtgggtgtaacgcagtaaacttctgatcatgatggctgaccttctttcaacattgcctcgggattatcaactaagtgacgatacgctggctgatcgcggtaaagctgtgcatgatccgcgctgattaactgatgatcgtgaataaaccaaacaacgtcagcttcggccatcgctgacagatcatgggaaataaacagcacaattttctgacggctcagtcgcttgatcgccgctaaaataatggcagcattcgcagcatcaatacttgatgtcatttcatcgagcaaatacaccgttttgtctgccagtaacatgcgcgcaaaggccaactgctgccgttgtcccggcgacagcaaccgcccaccttctccaacttcagtggcatagccatcttgcaaatcagtcacaaagtgcatcaatcccaattcgtcaagatgttgctgccactgatcaccaaattgattgcctaaaagcagattttccttgatagtgccggaaaaaatatagtcattggcagccacatacccaaacaccgacgcgcgttgtgcgttgctcaacgcagtgacgggcgtgttgtcagccataatcgtcccggataatggtgtcagttgccccaacaatgcctgtgtcaacgtactttttcctgtaccattttcgcctgctaacccatataacttacccggaacaagggtcgcattaatgtcggatacaagcggtgcgtccgcttcgtaaccgatagcaacatcttgcaaaaccaactccttcagcggtcgattatccgtgattttgactgttgcaggtgtcgtcttagacttcgcaatggttgccaaaataccggctagtgccggaccgttcgacttaaccacatggaaaaagtagccaagttgacgggcattcaccatcatcatggccaatgcaaaccaagtggcaaatgccccggcagcaggcaactgacccgcagcaagttgcagcgccgtcacaaatccaccagcaaacactgtcaaataaacaaagccattgataacaaataacacttgcaattgcgtgcgcagtaaattcatggttgcctgccgaaaatactcactatcatcggcgaactttttagcataccgatccgctgcattgtacatcaccagtgtgttcatgccgctcaaatcattcataaagcgaccacccatccgcagaaaaccggcaagatgcgccttgttttgcgctgacatctttttccccaaaaacatcatcgcaaagccgattaaaaaaacgcaggcaagtggcaaaaaagccagccatgaaccataccaaaccgacaagccaatcaacagcaaaaaggtaagacctgcttggattaaggttggaaataaggtgctataaaacatatctaaattattcaagccgccaagatcgcgctgaatcaccgcattatctgcagccgttgcatcccctgcattgttacgctgatacagcgcctcgaaatagtgatctcgcaactcacgcttagcactcatagcccatgcatgacgatgatgacgctcatagccaatcacataccccagccaaatcaacactaagatcactgtgatgatcagggcattcctcggtcgctttgctgcaaagttcaacgctatcatgattggcaacagtgttggcaaccagtcaaaaacagtttcaatcaccccggcccaacgctggtcacggccatactttagtaatcctaacaatgatctgcctctttctttcttgcctcgacacatgtcgcctttcatccgcaaatacggcaataatctataaaaatttaaattgtttttttagtttaccacgagaactcaatcgtcttgcaaacatttttcgacaaccttcatcacataaaagaccgtcaccagctgacaacaggctagtgacggcccgggactctcattatgggtgaaccaagccaccagtgtcaccgctcgttcccgtacctgcttgtgctggcttgatctcaatcagtagtttatgcggcagacaaatactttgctgaccgacctgactgatccatcctgtatgaacagcgatttgatcaggtgaattgtcttccttatcccgaatgcgcgccccttgcacttcaatgatgttgtattggccctttgccggatacaacgtgaactgctgatgacgcgtatgagtagtgagatgaatacgccgtttaacatgaccgttgatcgaaatcacagccactttttgatttgtattcacgttcgcttccgtcaacgaaaaaatgccaaccggaagaaagcatgccacaaataagacgatgataatcacataatcaaacggtcgaacatactttttcaaccagcgcactcgaatccccccttgtcgccgtctattttacacgtcatcaacatgcatcgtatgcacagatgttgctatttttccggcaaatgaaaagcaaaaaagctacgaatctcataggactcgtagcctttttgaggttatcttcatcaacctcacttacttagcggcttttgcggcactgataatcgcggtcaaataacccgacgtatcagtaaacgttgcaccagaaacgacatcgctgactttctttttgcccttcaaatcactaacagctgtttccagttcagcaatcgtctttcctttagcaaattcatcaatcgcatttgagttttcttgccaagtctgggttgccttgccttttgacttcataattgctgaataagcttcggaattggcccgctttgaagctaacacggtgccagatttgattcccttgccaaaatcggcattcgaattaggcacaccgccaaaatctttacttggcatatactggaattcatccaagaagacattcgcgatcttatccccttgcatggcgaccgtcacgattccaaatgattgggtaccatgcggcgcagcaagcacttgcccttccgtgatcgtgttgtctgttgtctgaatcccttcagctaccatcccggttgttgcggcgtcatagatagcctgtaagtaaccagccgtgtcagcaaaagttgcaccagaaacaacatcgctaacctttttagtatctttaaccttggcgacgtccgccttcaagtcttcaatctttttgccttttacaaaattcgtgatggctgtttcgttttcctcccaagtatgggtcgccttggcctctttcttcatcaatgcagagtacggcctgctattttccgccttggcaatcaaaaactggcctttaggataactcttgccaaagtccttgtttgaattcgggacaccagtccaatcggaactctttttgacatactggaactcatcaatcttagcagaaacaatcgtgtcgccattcagcgtcacatttacagcggcaaaggattgcttgccgtgcggtgcagcataaagctgacgtatcactaaggtaccggctgccggcaccttggcactcgcatcagcgcctgtattaatcttgaccttcgcgttgctcgtctgactggtcgtactactgctcttgctcgaactagagctcgatccactactacatgcggccaaccccatgctgaccaaaagtgtggcactgagcactattagttttttcatgtcgttcttcctcctcgttgtgtaagcgatttcatatataatgaattctatcacaaatgaaggtagacatcactggtttttaattgatatatcacttttcacttcaatgattgtttgaatattattgatacagaatgtcttaaatcaagctactttttatatggaaaattcatggaaagtttgtcctttctttcacaataaaagttatatttttgatgtttttgaaccgtctttctttaaaagacatttattgattgccaccctctttgcagtttgttagttatttcaacatttatttgggcttctcatatttttgacaaatctaaaccatcaattttcctgtccatataaaaaaccgtcatcaccagccgataacatcactaccctaacatcactgccagccctatcatgacgtgcatcaaaataaatgcactcagcgtcaccaccaaaatgttacgcgaacgtcgatagacccagtatagtggcagctgtgcgaccaacccgctggcaatattgacaaagacatgcggtgcaagcggtgtagttgtcacaacagccgttacggccagcgccaagagataagttaaaaacaatgcccaacgccgatgtttaatcgccaatcgactaaataactgttgactagctaggaaaatcatcaccgccgttaattgcgttgcaagcgtcatgaaaaaggcgcggaaactaatgaggctaaaagcacccaagttaccaaactgggcggcctccagcgtattgacaaaatcaacgccaaaccgaattggcaccaagtcgccaagaatcccgccaagtgtggtcgcaatcaggtacaaaataccataagcgaaaacataccagatatcccgccaacgaaaacttgcaaaaagctgcttcaagccatcccagccggctgcccatacagcgccagcaaaaatgatggcacagtaaagaacgccgccgaacacgacaacggctcgagtccagccattagcaacattcaaaaaggtggtgccggacatgttgaaaaatccgccaatcggattgcgtgtataaaagagcagataggtaaacaaaacaaccgagaagaacttcagccagttattgaacgtaaaatgcggttcagtttgactaaaaggaactggccattgtttgcgtttagctaattttgttgcttccaattatttctcctcctttaacacaagttgaacgaagccttccaagttcattgagaggacccggtctaattgattggtactgcgatgccgataagcatacgccgccgattcaaacatcatgtacatccgcccatcatgcgtgctgatctgttctaagtgcgaaggcatatcaaacgtgtcaatcgcatcactagcgcggaagatggtcttcttaggatcggttttaaagatatataacgtcgagttgccaccaccataagattgcgacagaatcgtataatccccataaaaggccatcccttggattttcgataaaatgtcttgatgcaaaacggattgtgttaacacgtcaaattgatttgagatgctggaggtgaggcttttcccaacaacctgccccttatcatttaaaggataacgttgaatgttaccttttccagttggattaaagaagccgacgaacagcgcattttcgtaataagtgacaaaagaagctcggctaatattgccaagttgggcgcgttgagaataagccacagccttggctttcttatcaacattgtaagtcaaggctgtttttagcttgattgcaaaaacttcagccgcattgttccggcgtccgcagatccaaatgttatcgtttttggcatcataagttaacccaccaacatggggacggccattcaataccactgtgttaagcaacttaccggttttcaaatcctgaatatacatcactgagttatgaaaaccgtcatgatcatatgctgtggttaataagtaatcaccggccaccgtaacgccttgtggggtcatggttgtacaaacttcaacttcgccggtttcagcattgagtgttttcgttgcctttagaccaggtactatcggctgactgctatatttaacattgaattcgtctggcgtatagttaaatgttttagcatctttaaccgggcctaatcgaaccattaaatccaagcgtttaaactttttcagcgttttttcgaagcgactttctgaatataagctgtcagtgttggtctctgtccgtgacgtgttcggctcaacttggtaacgtttaaccgtcccaatcccccagccaaaaccgccaataaaaatgataatgagtaccaaatcgacaatcaaaatcatgagattttggcgattcaattttttcttcccatccctattcaaaatacgttcacccttcacgttctataatcgttatatcaatgtcatcattatagcaaaccttgcttctgatccgcatcacatgaccttttgtttaacaaggtttccttataagataatcgagtcattttaatgttcgaatgaatgatattattgttataatttatacaataagttgcatatacaccgtttgggaggggatatgaatatgaaaaaaatcttgattggtattggcatcttcattggcctcgtcattcttggcggtgcagggttttacgcttggtatactcaaagcaccccttattacacccagattacgacgacaggcaagaagtttgatgttatcgatgatgagaccggtgctgcgcgggatattgattatgcctatactcagatggcctatgatgaaaaaggccacggtacagaggttgatttcaacggtcacaaatctcggcctttgaaaatgcaagcttatctccgcctcgattacagcacgcgtcgaaaccaagtgattagttgggaagccgtaccaaaggaaaaggttcctaaagcagctttagcaaaattaaatcgctaattaaaaaaggtgcgctggcgcagtttgaaacctgcgccagcgaacacatttacaaggagatgtctattatgacgaatgaacacaaagttttacgcgggttgtcttatatttcggtcatttttgcccccattctctttccaattctcgtttggattttcaccccgcaaggttccgttacacgggacacagctaaacacgcactttggctgcatattattcccattcgagcgtatcttcagcggcgctaacccgcgtcatcactgactttctatgcctcacctgccgttttggcggggagtttggcggggcttaattgatcgtacttcaccgcctgatttcccacgaaccgcacctgattctgacctgccgtcttgatcttgatattgcctgaaatctgctctgcgatatcagcatccagcccgccccacaagtgcgagtagtgcttcagcgtaatctccggcgacgagtggcctaagcgcttagacaacaccagcactgagacgttgaactcattgatgagatacgacgcgtgactgtggcgtagccctttgccttcgactgggtgtacctgcgccaacttggcgtagcggtgaataattcgcgagatcgtggactttgtcatcggcaacccgtcgtaggtcatgatgaagtcatcaaccccacccagcccgaaacttgtctgtacctcgcgccagcgccgcagaattgccacggtgtcatcatcgagcgtcaagatgcgcttgccgctgtctgtcttcgtgtagttgtggcgttcccagtcatgtcggttcttcatcaccagcatgtggtcaacgtgtagctgcttcttggcgagatcaacatcccgccaccacagcgctgtaccttcgttgacccgcacaccagtcaggaagtacagccacaacatcacgaagttcaggtgcccgtagatatcatcaatgcagatttgcgcgataacttgttcaaactcggctttcgtccaaaatggtacgctgcttttggccttggggatcgccttaacgcgcttcgacacattgctggacagatactgcatctgcaccgcgtggtcaagggacttgcggaaacagccgaacaccaatccagcatagccttgcgagtagcccgcaccgccgtctttctcatctgtgagcaaccacgtgcggaagttctgcacgtcggtgatatcgatgtcacgcagcagcaagtcgccaaaccgcgcgatacagatatcaaagctgcgattacggacggcgaaggtgctttcctccacgtcggttttgtacgctgggatatacgagtctttcatgaattggcggtaagtcatgcggaagttcgtaaacccatgcgcctcatgatattcacgcttcacccgcgtcagctccttgttcgcggcaaatgcggtactgaatggcattccttgactgtccttccgccctttcttgcggacgcgcttgccactcatcttgtcggtgcctaactcggtttcatagtagaagttacctttggcgtctatgaatacgcctggatatttggttttactcattctcaacagctccattcatcggtgatccgagaatggactcaacgacagaacgcggcacgcgccctaagtttcggttgagatacaagggataacccttttgtaccatcctttgcttcgcttgtctaatgatatcgcgcgcggtgtgctgcttaaaccctaatgccatcagatcttgatagcagacaaaactcttatccaattacgtcacttccttctcattgattggagtgagataatcaaaccagataggacccaaatcttatctgtgaagggtgactacttgctttggtcggcatagtcgctcttttttgatgtctcacttggttctgcatccgtcaaaacgccattacggtggtgctgatagtgatgaatcaaatcccagtgccgttgggttaacttgccgccatcaatgattgccttcagttcagcggtgccattgtactgatcaataagctgcaacatcttcagtgacggcgcgacctgtttcttcagccagcgagtaatgtgcgcgtaactcaatggttcaggattagtagataaccgcagcttgtcgcgataattgccgatgaaggcatcccaacgcggatctgtcgtccactgactcttcgctttgtggctcggtgtcaaaaaacgcaggtaccgattgatgatgccgaacacgactttctccggatcacgttccgccaacagattcttaattgccgcagcggcacgtttgcgacgtagccggacctcaaaccgcgtgcgtatcggttgatcttcaatcgcaatctcagggtgcttctgatattgctcaaaggccttgtcgtaaatacagaagtaaacttcactttgcggcgaccccagatataaagttctacccgatacctcccactgcttcgtacgattatctcgaaagccgtggaaacgcgaggtgaattcatcccggtcacatttctcaatcaaggtcggcacatcgagcaaaccattacgatcattgatggcgaggtcaacccgcgtgaagtgaccgtcaagcgcaatgcacatctccaagaagtcgtaccaagtccggttctgctggcgcaaatacgattcaacatagcggcaaccttggcctttcaactcaatcatcgtgccgctatcctcacttggatcataaccatctgcattcacatcttgatatggtgacagcaacacgtcgatttcaccacatttgaaggttgccgcgtatccataacgcgcgccttccttaagattgaagtgattcaggttgatctggaacagttccgtcaccagttcttcataatcgtgagacttgaaggtaacgcccaagtaatcaatacaaacgtcaatgttgttcaggccggtcagcgaccgcagcgccaatgtcaaccgcaatcgcgcttgcttgttaatcgggctcttccctgtcagcaactggttcaaatgcgatcgactgtaatcggccgtcttcgctaattgaccttgagtaatcttgtgcgtgcgcatctcatcatgaaactggtttagccagtcggtattcgtcattccaccgactaaattcaaatctttcagcatgttagctcctttcgaagcgacctgacagcaaagccttctttctgcctacgcaaagtagcttgccaccggcgctttcgtcctacttacgtgtattttgtctttaatatttgcccccctattagagaccgggggctcgtggcggccggctaacgccgaccgccgccgctcgcgctagcggctttcgcgctgcacgccgcgcacggcggcgtatgttgcaagacccttccggaaggcctgtgagaactttcgctctcaacatatacagacggtttgtaggacgagttttgaaactgaaagttgaactgtaacaggatcttaatgttgcaaacaatttggcgcaatacatatccagaagattcaatgcatctcaatctacccaagcaccaatcgttgaattagcgagtccgcatcattctttacagcattcaatatttgtgggacattatttgagcacgagcaagattaagacaaaaaaagatgccatcatgaaaagtcggatgacatctttcggtacaactattcgtattcgaacctagatgaggttactttgcacgtccaatattaattacggaattggcaattcttttttcattatcaataggtgttgtgtagtaacgctgatcgataccgtatatcaacttttttagatccgcatccgagctgattaagaactttccatcttcgaaacgcaatcctaaatcatacccttgaatgtattttttaaggtcatttctctggctattattataggcattatacttatcccttagggcagcaattcgcttgcgattgttaacttgaacagaatcgccgttaaacccttctgctgtttggataaaatcctgactgagaaagtcagaaatttctctcttcgttgcatcacgatataaggcaatgattcccggaaaaatcgcctcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggccttgatattatcaaacttcagaaaatataatacatccgtgtcttttgaatatattgcgtccgcatggtcaaaaatcgttattgtgctacccttctctgaaaaatcatacatattgccatctggtaagactcgaagaaatcgttttggcttcagcgatgctgtggtaatccgttggaaataataaatgtctccttcaacatttatcaatatttgcttgtcatactcggctttatattcgttataatcagtggtacttaattcatgcttcaaaatatcaagacaaaatgagtgttctgaaaaatttgaaattttgtatacttggttagagctaattgcagtatcgggtgtgtattcaaagcaaccatcagagtggtcgtaaagatcgtaaagcttttcagtcacgccttgcaatgtataaatattttccttcgcttcaataaatgtatgcgccatattattttctcccaatgtaagttaaattattgattctgtgcagctttaaattatccaactcagacgattttcggacaacctcattgcttttcagaataatgatagtttgtacgccttgttcactttcagctttataaaaatgatattttagaaataagaacattggattgaaatactctgatccagaacaaaacacaaaaatatatataagacaataaaacgcccacattgacacatagttatccacgctcattgaaacgaagaaatatccaaggtatgagggaacaaacgaattgtcaacaagctctattagttttgcttttgcaaacagttcatccttggaagccctggttatccaaatgggcaccactaccataatcacagttccaaaaactagtattcctaaacgaacaggatgaaattttatataactcagtattacctgataaaggaatgagacatctgcacgctgcaaaacaaacagcttcctcaaataatatgaaatcacaaatatccacgtagacgaaatcgttagactaaatctccgaatattatttatcatgtgtttttcctcaggtactagacaggctctgaagatttgtgattaaaccgttgacgacttcctctatggtattcagaccgacagcaaaccactcacgcggcttaacaattcgtccgttagctgcggtaatatctacatctaactggtattctgctaaagcatgatgcagtgcagtttccaacgcttccgctttcaagttcaccactttgatttcgccgacaagtcgtactggaccatatagataagttgactcattctcggcgtaggcaattctcgcctgcacggatccagttgtaaacccaaccttgtatagtggatgctcagcttgtattcgcttaatctgagggttgttgctcaaagattccagtatatatatgaaccccgtcacgtggtcatcactggtcagttcaatcccgtgctcaacttccgtaacaatcctaccttgacgcccatacagagatgaagcaagcccatttcgcgtcgggttgttttcagtcccgttatcgtagattacatgcatccttgcgtcggttttccggttgctattgtcattaagctcaacttcttcgccaatctcatcaatatacagtaactgtcccttaagaacgtagaagtgcttgctcagcaactcgtaattcttgaacgggcgaagctgccgctgaccagaagcaagttcagcctgaaccttgtggaacatcgcctcatactgactgaattccttcatcggtttacgctgagagatcacttccggacgattttcttgctcacgctgaatttcgttgagcttcttggtatcgaacaacttactaccggcagcctgctgatcacttttcttaaacagaatggaatcatcgctaagaatatcgtccaacgatgagaaatcccgcttttcgtttttcacaacttcattcaacgccggaccgtcttcatgaacagtcagcaaccctgcggtatcatacggcattaacagattccggcgttctggatcttcacggatacctttcaatcgacttgccaacttgcgctgtttcatctgtgagggatctcgcagcttctgtggctcgttaccgtcatgagcaatcacccaatcggtaatctcttgaaatccttctaccgtggggtcatagcttacgggagtatgtttgggtttgctagcgagcaaagacgttgcgtccggatcattaaaaatgtcatccagcgaccgaatcaagctttgattatccattctgctgcctccgtgcctgcatatcccttaatttagcaagcgcatacgccatctttacctcaagctcgtcgcgacttcctttatctggttcccgaccgttatcggcgatgaattgcttagtctgattgtacaggtagacgagttcagcttcatcgaagtcaaacttcttagcgtcaatagaacgctgaattgtccgcaaaacgtcactgtcaatattctgggacagcacttcatatgctcgctggaacggattgatggaatcaattaagttgatatccaactcgtcgacgttgatgaacttatcagccattcgtaaaaattcattggtgttgccgtgcttgtccgtagtttgatccacgacagcatgccgcagcacagtgtctgctaccgcgtactgacggacttcttcgacttcctcattatttagccctgggtagcgggtcataatgactttaggaatcagtaccttgttcatcgtctcagcgtctacattagccgcaataccattcttcaccgcattatcttgcaggatagccgccttcaggtccggcatgtcattctcaatgatgctccgaaccgccttggttgatggatctttcaatccgcggacaaagatatcaccaccattacctgaagacttatctgccttatgcttgcgtgctttcaggtgaatctccggagccagtacttgctccatcaacaatgaggcagtaatcgccttgagaattgagttgaccgcatactgcacatcaccgtctttagcatccggttgttcaatcatattcgtaaactgggcatgcgtcttattggagctatcacgcgtaacccgaccaatgatctgcacaatttccgttaatgaacggcgatagccaatagtcaacgcctgttcagcccacggccagtcgaatccttctttggccatgcctaacgctattagaatgtcaagctgatcagcctgcttcatcttacgtaagtattcttgaaccttgtcgcggccttcttcattgactaggtcagcaaccttcaataaacgtccatccacatggctcttgagcacgtatatccccgtctcatcgtcctgcgactcaattgtgccaatcgtatcaaatatagcatcaacctcattgtatttgtccttggttgattcacttgagttgacactaggaatatgaataatggtcttcttagacacatctaccgccttatccaaagccgtcagatacgacccttgatagaacttataatcaataccaaatgacttcaagtatttgtagccgtccagttgttcgtaataggtataattaaccttatcaaactgttgctcatcttctggcgttagaattggcgatgaatcgccacggaaataagaccccgtcattgcaagaatatgcgccgttgagttgtgcataatgttcttcagcgcaccgccaaggacagaactgtcttcagaagaaacgtggtgaaattcatcaatcgccaacattactttgtcgaacttgtgatcatcgtcgactttctcatatgcaaaacgcagtgtggcgtgcgtacagatgagaatggtggccgtatcatcgttcataaaatcaatgaatttttgaaccttacccgcatccccaccgtttagagtaaggtcatactgcgaatctactgaccaatcttcataaaacccaaacttagccaattctgtatgttggaaagacttcccgattgagcgttcaggtacggcaacaataacctttcgaacaccttgattagccaacttatcaagcgcaacaaacatcagcgcccgtgacttaccagaagctggtggcgccttgaccaagatgtactgtgaactacgatgttgatagacacgtgcctgcatctcacgcatgcctaactcgtctgtatttgtgcttttcccagttcgatgataactaacatccactacatttttattctccaagtttctgcaccttctcctcgtacatttgcaaaagtacagacagtcgttgagatctattcctaaacccatcctgcctatatgcgtgttctactaccgaatccaatttttcatgaatcttaagtaatctttgattcataggctttggcttcttatcggcaagcggagacccatacaattcagccaagcttccaccttcttcttcccgagcatctaacaactgatagacaatttcctctatttccatttttcgccttgcggaaatccgaggaacaggaaaagtattgtagtcaagtgagacggaataattataatccgtcttcattcttcctccgaccacgtcaacccaaagcgtatgcatcgaagattcaagaactcctaacagccagattggtgctccaaataccccaaacatagaatcggaaataatcgtgtccttgtccacaaaacccataggaatatatcgtctggtagcagatgaaactttcggtacaattactccactctctccttgatatctattctctgcaaatgaatatggcgacgtggccaagtctcttgttgctttctttttactggccaagcgtatccccctaacctttgaaattcgttgagatataatcggattattttttacggattggtactcttcattatccaaccataacgcatatcgatgcgtgttcttaataaattcagacccacctatatgctttttaaataatgaagcaagacacggatattggtttataaagctctggtactcatcctctgagaaaagcaaaccgccaccatccacagccttactcccatacaacatatccggcatatcgaaaaggtttgtcgaactcggttttacaatcacgtgactctgcgattcaactaaatacggcgtaatattgcttgcttgagtaactatactttcagaatatagtagttttttcgcctctacaaattcattgcttgatagcccaattacaactaccatcacagcagcattttgctttgcattgttttcccacttaaatgattgatacgcaaactgaatctgtaaattctctaacaaggaactccagagcggataaacttgaactccttgcgtaacagaattcgtcgtcacaaatgcacatcttgcctttgtgccagaaatatattctcctccaagctttatccatgcacagcaataatccaagaaaccatttccttgaatattcttaaaaacgctctttatctctgacttctgctccttgctttgcagtgaatatccaagatacgggggattaccaaatagatatacttcatcaccttgttcgtgaggaagtatgtaatcccattttatctttagtgaattctcgcaaatgattgcaccggcatgctgtaacggcagagttggccgcacggcatcactaatctgttgatgcagttttagattcatttgatgttcggcaatccatagcgatagccttgtaacatcgcatgcaaagtcgtctatttcaataccataaaactgatcaagtgttactgagggaaggtaataaacttgaacattcggaatcctattcaattctttaataatgtcaatttcaagctgccgtaattccttgtacgtgatgatcaagaagttaccagaaccacacgccgggtccatgaacttgatttttccaattcggtcatatagctgctgtaacttgttttcgttacccttggcggcttcaaagtcttcacgtaatccatccaagaacagtggcttgataaccttcatgatgttcggcacggaagtatagtgcatcccaagatgactacggctatcttcactggcaaccgcctgaatcatcgagccaaggatatctgggttaatctgatcccacttaagcagctccccagcttcaataatgagcttccgagacttggcactaaagtgtaaagattcatgctgatctttgaacaagtcgccgtcaacatacgggaagtcattcaaccaactaggagtatccatcgaacgctgactcttttcaaagtccagcacgccaaagagactaccgatgaactggtcaaaattgctaccgtcatcagcagtcatctgcttaacccgattagtgaacaagtcatgttcaaaaatattggtatcttcggcaaacaggcagaaaagaatacgaatcagaaataggttcaatcctttgcgtgttgcatccgggttatctttaaccacgacatcgtatagctttgcaaaccgttcagccgcccggacatcggcagggttttccttatcgaaatcagccttttcaataccattccatgcaagaaagaagtcaaaatactgtggcaacttcgcaaattcgatatcgagcgtctcgttagtctttgtatccttggctagcaagtgatggtagtccgtaaccagaagataacgcggcttggaaccaagctcgtcgacccgttcttgtaagtcggcatagtcttgcattaaatcgccagtgccttctctgaagtacaacttgtttttcagatagaccgcacccgcctctttcgctaggttgttcattcctttgcgtagcttggtaacggttgctctaggaatgtcataaacgcccagaaaatcataaataaactcggaatggtccggtttgcttacgatttcttgaatctgatcttcgtactcggtgattgccattttgttccccctacatggtgttcttaatctaattatctaatagaatatggcaagctacaagaaggtattaaataatgtatagcgttttctcgaacgactacaaaaatccccgccaactcgaccaaatgggccaccttgccgggaatcctcacaggaaatttaacattccaatttaatatacaaacgagctggattactataatcgaattcactttactaactcgcacctattcgtttgaagattttttgatatcttcgaggataacgttttgtgcctgcttgatttggtcaggcgttgctgtgagtgtggtttcaaaagttttaatcaatcggttacccataggtcgaaaagtaatcaaggtcagaccacccgagacaaagccaccgataacagggagtgactttgagatcacagcagaggttgtttttttggtcacggagacaccaatgtatccggcaatctttttcaatagcggataccacgttgtgcgagtgaccgcggttgccatgaacttcttgcttagtgtattactcagtcccttagagataaacatcaatgcggaatttgctgaagctacgcccaacatcacaccgagatagatcatgacatcacgctcgccgtcttcagacaatgttccctcttcagtgaagagattttcttgaccgtaaatataagcaaccttttgggccatacgtaaggcaaaaccatagtactgtacgaggtcagctgtgccggttccagcagcgacagcgatatttgaaggcaatcctgcggcaaatgaaatcgccgaggtcttctcggtatcgtgcatgacgacgtgacgggcaaccttagtcagctgctccaatgtgtagacggcttgcgggccatctttaagaatcgacatcaactcgacttctgtggcatgcggaaataatttggttaagaatgtgcgccgatcaacgcgaacgactggtagcgctagggccttggaaattatgtcaggaagcatatgttcagtttgttcagacatggtgaactccttagaaagaaaatgggttagtagatatacgattacggattattggcatcgtagtacgaaactgactttttggcaagcaactctcccaggccgctgatattagtggctctaacaacggtaaggaacataagcacagactgacgaactaacctaaaaatccccaccagtccagccctcattcggcccaaacttggcggggattttggcggggaacgtaataatttccccgccaatcgtatcctttgtatcttccgaaaatgccgttaaatcaacattccgggttcaatttacatgtaccttttattcccaccctattgagcatctttatctttatgatcattggcggtgtcggtttcttcacgaacagcatcaacgcaacatccgccgtttcacttatcttgctacttgttgccatggtcgttgacattgggatggtagtctacaacatctacacaggcattaaaattatcacctcctgattaaccactcaatatcgccaaaaaagggcgcctctcgtcatgagaagcaccctttttggtttatcaaaatttcaccgtagccccgcatccaaagcatacaagttctgataccgctcgtcgttcttagccaagtgactaggggtatcattcatcgtcaaacggccatcttcaagaaaaatgacgcgatcagtttgattgacgccttgcaaatgatgcgtcacccaaagaatggttttgccttgcaatactgtgaacatcgtctccagcaaagcctgttccgtaattggatcaaggccaactgtcggttcatccaacagcacaatcggcgcatcctgtaaaagaattcgagctagcgacaaacgttgccgttcaccacctgaaaagccgaaacctgcttcctcgacactgctgttaataccattcggcaattgggctacgagctggtctagcttgactgccttaagagcagcggcaacatcagcatcgctggcctgctcattgcctaagcggacattgttgacaatcgacgtgttgaataaaaacggactttgatccaacacggcaaaaagattggtgcgatgctgctgataagtaaggacatcttgaccgtcgaccaacacgttgccagttgtcggcgttaggtcaccaagtaccagttgcaacaacgtggttttgcccatgccactaggtccgagaatcgcaattttctcgccgctgtgaacggttagatcaatatcggtaattaattcaggatcttttggcgtgtattgaaaactgagatgctgcaatgtcatctctttgaactgagtcggtactgcttgttgttgcggtaattgtcgcgtgaccggctgcaaatcgttgagatgccgaatcgcatcgcggtatgtcggccattcgccaaccccttgtgcgatgccggaaaacgcctgatcgagtgggaaaacaaccagtacaaacgccccaacccagttagcactcgcttgattaccggtccactcaaggtttgtccagatcaacatactaatgacaattaagacaaacagcagttggccgacaaagtctcggcgccattgaaatcgcttggacttcaccgtcgatgcggctaattttttaggggccgccagactttgagacataaaatccttttcacgatgagtaataacccaatcggacaaaccgagcactgaatccgtcaatgagacataggcatcatgattcaattgcttttgttctgcctttcgaaaacgctcaactaccagtccccaccaaggcagaatcaatacttgaaacaacagcaacaacataatccatagtgcaaagccccagttgaaccagcctagcaacaaagtggcaataaccgttagaccagcgccgaccacagttgggaaaatcatccgcaagtatagattctgaatgtgaccaatgtcatcggcgagcaagcctagaatatcgccggtttgatgatgttcggacacaaaggcagcatcagtttccaacactttgtacaattttcgccgcatgtggctagtaatgcgcaacacccagttgtgactggtcaaccgttcaatgtattgaaacaccggtcgcccaatcccaaaagcgcgggtcaagacaaccgtgacataaatagctgcaaacaatggcttcgtggcacttttatcaatcagaaaacctgacgtgaacatcaaggcaccagcaaagacaaaagtcataatccccagaattaacgaccagaagagtaagccgcgatagcgtttcaagtctgggcgaacccagtgctcatttttcaaccaatgcattgaattcacctcgcatttcgtgcacaagggcctgatacggcttggaatgtgccgccagctcacttggggtcccttcagcaatgatcttgccgccatcaaccacaatcacgcgatccatttggttgagccagtgtagccgatgggtcgcaaaaatcacgagccggtttttgaacagcggcacaagcgtttcttttaactcggcttcagtttcaatatccaaatgggcagttggttcgtcaaacaaccaaatcgagcgattcgtatcaatcaaagtccgcgccaacgcaattcgctgggcctgaccgccggaaataccacgaccgccttccccgattctcgttgcatagccgtctgccaaagtttcgatccaatgactcaaccccgccgcctcagctgcctgttttacatcttcatctgacgcatccggccgataaaaccggatattggcagcgatcgtatccgcaaatagatacggatcttgtgggatataactcaaatgatcttgccaagctgcttgggtcatatgcggtaccttcgttcctcgaaccgtcatggcagctttttgcggctgcaagaaaccgccaatcaaattgagtaatgttgatttacctgacccgctagctccgataatcgctactttttccgtgccggtaaactgcagattagcatcttgaatgcccgcgcgttcatttggataggtgaaatcgaggtggttaatggttaccgtatcctgagcctgccaccttgaaaaagccggtaacacattggtatcagtaggtaatggctgatcaatcacttgccaaatcgccttcatcgcatttttgccattcaaggtggcgtggtagtcagtcccaaaatcacgaatcggcatgaaatattccggtgccaagatcagcgcaaccattgctggatagagtgggatcgcgccatccatcaacttgatcccgaggaaaaccgcaacaactgcaatcgacaaggtggtgaagaagtctagcgcaaacgttgagagcatcgcgatgcgcaagacgcccatggtttgttttcgatagtcttccgacacatcgtacacattattcgcgtattgccgactaatccccatcaactgcaaagtttttaaaccacgcaaggagtcaatgaaatgattgctcatcttttgaaacccagcatattggctttcagatttatcctgtactgccaagccaagaatcaccatgaataaaatgataattggaaacatgatcagcaaggtgaagccagttagccagttttcgtaccaaatataggcaactaaaacccacggaataatactcatgttcaggattttgttcaaaatcagttcaatataattttcggcttccggaatgccatccagcgccatcgtgaccaaattaccggttccttccttggcaacggcagccggccccaacgcatacaagtgcttgagcaattgggcttgtagccaggccgaactagtcatggcaaatcgtgccccgatgcgattgcgcacccaaacaatgagctgacgaatcacaaaggcagtcgcaaaaagtcctaacggaagccataagccagctaaactttgccggttccaagaatgaacgatcccttcagcaagaaattttccttgtaataaaataacaaaagcttgcacgagcgcaaacccggcaagcattgtcataattcgtttcattcccgaaaggcgcatgagcgtcttatcgatcattcactaaccgctccttttgcttgaatccgcttgtggaagaccacatagctccagatgaagtatgccaaggcaattggcagcagaatcacagcgacaatcgtcataatggtcagcgtcaacggactagcactggcgtcttttgccaaaatggacatagccgcatcttggccaatcataacgcgtgggaacaagccgttgaaaatcacaccgacaaccccgacaagccctagggcactgccaacaaatgacaacacttcattatctttaagcacgccaacatgagcggcaactgtcgagccgacaatcacaaccaaaatcaacaaagtgctgattgggcgttctttgaagaagtcggtcataaagaatagaaggacagcgaagacaacttcaccagcatacaacaagtagtacaacttgctgttccagtcacgcgcacgcttgcgcaagtcgccagtcgttttcagacgaataaagtttaaaccgtgcatgagcatcatcaaagtgaccgcaactccgccgacaattgtcaaaaggttgatctgattacctaaagtaggataaacatcgccagccttggtaattggtaacggttgaatgatcgcggtaaaaatcatccctaagatgaacggtgggattaaactgccgcaagctaaagcccaacgccagatattccgacctcttttggtctcggcatgtgcagcaaattcaaacgacacgccgcgaacaatcaaaccgaacaacacaaggaagaacatgatgtaaaaccccgagaagaggctggcataccacattggataagaggcaaacatcgcgccaccagctgtgatcagccaaacttcgttcccatcccaatgtgggccgattgtggcaacgagttgatcttcttcgtcagagttacgcgccaatagcttggttgacataccaaccccgaagtcaaagccttcaaggacgaagaagccgctgaaaaggacaaacaataagaagaaccacaaaatctgtaaccagctcattttgcgaacgcctccttagcaaacggatcactgttgaccccgtagtcagtgttcagatcgccttcaggacccttcttaagcacgcgatgtgagtaataaatcatgacaccgccgagcaaggtgaagatcaagaagtagcaaatgttagtgaacagtaactgtccagctgtcgttgtcggcgaaaccgcatcggcaattgaatacaggccgtaaacaacccatggataccgaccaagttcagtgataaaccaaccagccgtattaatgatgaatgggagccacagcgcaaagccgagaatatacaatagccaacgctgattaagcaaggtatctttcttcttccggctaaaccagagacctagaacgccgagcaggaacagaagaacgccaccaccagccatgacccggaagctccagaacaaggttttaaccggcacataatagtccctgtctttgccatatttagcttgaagctccttattagctgtctccatgcctttgactgcgccgttcattttatgatacgacagcaaacttaatagatatggcacttcaatgttgccagtggtcgtatgatctttagtattgattaattcgacaagcgtccacggtgctggatcactggtatctttataaattccttcagttgccgcaaacttcatcggctgatctttaatgatgaattgtgtctgcaaatcaccaaaaccgattgcgcatgcagaagcgatggtgccaacaatcaagccaactctaagagacttcttgtaaaagtcaacttgatcttttttaagcaaacgccatgcggccatgccggctacagcaaagccagccgtcgtaaaggcaccaaaaataacatgcggaaattcaacccacagttgcggattcgtgatcacagcaccaaagtcgactagtttaacccgacccgttgcttgattaatcgcaaaaccggttggatgctgcatgaaggcattcgccgacagaatccaaatggctgatagcgtggtacctagccatgtcatccaaataaagatagcgtgaacagccggtttgaaacgatcccatgtgaacatccacagaccaatgaaagtcgattccatgaagaatgccagtaacgcttcaatcgccagtggcaccccaaagatgtcacccatgaaccgtgaataattagaccagttcatgccaaactgaaattcttgaataatacctgtaacgaccccaaccgcaaagctgagtaagaagatcttgccccagaacttggccatcttcttatatgtttcattctttttgcgcacatacatcgtttccataatggcggtaacaagccccataccaattgaaaacggcacaaagaagaaatggaaaacggtcgtcatcgcgaactgaaaacgagctagcgataatacgtccattgccaatagcatatgtttttcctcccttactagattgattccaatctaagtatacccctgagttttattttttaaaaaccaaaaacccaaaaaatagcattgaaataatgcttttcagcatcaacatcaaatcaaaactgttatgatatgcagctgtatgcttaattgacggcgtttcggccaccaaacaaatattagctaaaaccattttgaaaacacctttgaaaacgatggaagaatgaaaacgtatttaggggcgaatcacttcttgaatcagcggcgtttttttcggcgctttatcgccaatatgataagcgtttctgaccatgttgctgatagcgtcaacgttttcggtgtcggcatgcagcgtaaccaacgtatcgcctttggtcacaggtgtccccagttttttatgcagaacaagccctactgccaagtctaaaatatcatcttttttcgctcgaccgccaccaagttgcatcgctgccaaaccgagagcatttgtgtcaatttggtcaacaatgccagattcggcagctttcacagcaattcgatacttagcttgtggcagtttgcgtggatcgtccaccactgaagtatccccgccttgtgctgtgatcaattgcttgaaggcattcaacgcacgcccgtcacgcagcgcatcttcggctaagccgctggcaatctctagacttgccgccttgccgccaagcaccagcatctgtgctgccaacgcaacggtgagatcatggacgtctttcggaccgcgatttttaagaatggcaatagattccgcaatttccagactattaccaatcgtaatgcccagcggttggctcatgtctgtcaacaaagccacacttttaaccccagcggttttgctgatacccaccaaggctttggccaacgcccgcgcatcttcggtggtcttcataaatgcgccattgccgacttttacatcaaagaccaaggcattcgtaccactggctaactttttactcatgatcgaccccgcaatcaacggaatcgattcaaccgtacctgtgacatcgcgcaaagcgtaaatccgtcgatctgctggcgtaacctcgccgctcgcactgataatggcttcattgatttgctgtacctgctgcttgaattgggtttcgctttccgcaacattgaagccaggaatgctctcaagtttgtccaatgtaccgcccgtgtgaccaagaccgcgcccggaaatcatcggcaccggcacacctagacacgcaaccagcggcgccaacggaatactaattttgtcaccgacaccgccagtactgtgtttatcgactttaatacccggaatatcgctcaaatcaagtacgtcaccggaatgcagcattgcaaaagcaaaatggctgcgttcctctggcgtcataccattaaaataaaccgccatcagaaaagcactcatctgataatccggaattgcttttgccgtatactgttcaatcatccaagtgagctcttcattggttaaagctttgtgatcacgttttttcgtgattaaatcgaccatgcgcatctctcatcacccttttcccagttattcattccattgtaccgcgtcacgcgccgcctatgttaaactctaaacaatcagagcgtgaaccagcccggtcagaaatcggagtgtaagcgggtctgaacgtgatgaccgggtttgggtcattgcgttcagggtccttacacgcaggtttctgggctggtgaacgcgtttaaaagagcgtgaactggcgcgtttagaaaccgaagcataagtggccttggatgtgatggtcgggctttgaccattgcatccaaggtccttacacgcaggtttctgcgccagtgaacgcgtttaaaaagacgcgaaccaatcacccctcggtcatgccgaccactctttattgcctgcgaacttgtttaggaggaaaactcgatggactttcaaacattacatcaactaagcaaaaccgaactacattgtcatttagacggctcattgtcgttaagctgcattcgtcagctcgcgaaaatgatcgaccgaaaattaccggcgactgacgacgagctgcgacgactggttcaggcaccagcagattccgagaatttaggtgattatctcaaagcctttgacttcgtggcccccttgctgcaaaccaaaaaggccttgcaactcgcggcctacgatgtcgttgaacaagcggctgaagaaaacgtccgctatatcgaaattcgcttcgcgcccgtattttccctagcaggcggattatcgctggtcgaagcaacgcaagccgtcatcgaaggcttgcaccaaggcatggcaacatatgacatcatggcgaagcccttagtctgtggcatgcgacagttgcccaacaccgataaccaaacaatgtttaaaaccaccgccccactacttggttcaacactcgtaggcggtgactttgccggcaacgaagctgattttccaacgaacgtgtgcgcgccggccattaaaactgctcaatctcttggcgtgccgcttacgtttcatgccggcgaatgtcattgcccgcaaaacattgctgaagcggtacgactcggcattccgcggattggccatgccaccgcttgttttgatcaaccggcactcattgagaaaattgttgaaactggcaccacagttgaactttgcctcacgagcaatctccaaacgaaagccgctcggacacttgctgagtttccgtatcaggcgcttaaaaaagctggtgccaaaatcaccattaacactgataatcgaacagtctcgaataccacgttaacccaggaatatcagcgttatcagcaagcttttggtacaacagcagctgactttttagcattcaatttaaacaccattgatgcagctttcattcctgatgccgataagaaatcattacgcgaccagttacatcaagattacgcaacttattgttaattttccccaattaaaagacaagccatgatcacgactatggcttgtcttttttaatgcagttaaccaaggccttgctgatcaggcgcttaatcattgcttaatgaaagcgccacaacttcgtcacgaataaagcccaaattcaccgcacattcatcccgccaaagccacagccccttgttatgctggttttatcaacaaacgaaagaaggatgatgcatatgttgattaatcaaaccgatgtcatcgcaacccaattacaacaaattgcttacccgtatattaacgccattactgaaaccggcgtcccgatcacaattacaaccaatcaaaaacagcgcgatgaccccgccttttggcagagcatcagcgctatcctgaaagctcgtttatgggtacccgtttcaaagaagtaccatgaattaaccgaccatgactggctggcgacaccagaaatgccctaactaagcttgataacttgaaaaggccgtcgcagcaagcaccaaggtcaacacagcatctggtgaaagtgccgcactgactgtttcaatatggccgctggttgcgactgcgccaatcacttcaagcccgtacttaacaatattcaagtcacgctgcggagtatacccaccgtcaaaaacgggttcatgattgtatgtaaaattcaactgatcatttttgattgagccatccacatggttgaccatgatacggtcatgggtggcggtcaatggcgcattgtcatctggcaagtttaacttgtgatcagattcaattgtataataatcggcctgcttcatatgcaagtatttctcagctggcttcttgagcaccttcaaataatccacaattgcgtatactttgttggggtcaagctgggttttcttggccatcaggtcatcattatgcgcctcaagccagtctgctaaattactgatactaaattgatccatgttgtgcctccatattcgttgctaattcttacgccagtatagcatggtcttcaagtctggcgaagcgggattgtcataaacttgttacacatactgttatataatagtagtgggagatgaggatgatgctgagcaatcgcgagccatatccaattatcgattatttaggccgacctatcaagttgtcactgtttgtgacctatcgattacgcattaaaaacggctatatccttgcactgcgccgaaatcaacatcagcaagtgatcccgaacctcatggccaagaatgctagctgattcggttgctgcaacagccactgatgaacggttactaattggctaggatggtgtgtatcaatgcaccatccttttttgatggcgccagatgcggcctgatcgctcagtccggggagcgatcttccaacttcggtccatgcggcgtcaccattgccatcatggcgactgtcaaaataataataacgccacccaagatttccgcaaaccccatatgcatgtgtaagaaaacgactgaaacaaccgttgcacccaacggctcaaaggcgtctagcaacgtggctgccgtcggagaaatgaactgcaagctcgcaaggtaaaccgaataagcaatgatggtgccaaaaatcacaatgaaccagtaaccagcccaacctgcgtgatctaaatgcggtatttccttccaaaaaggatcaaatacatcaatcaacaaaccaccaatcaattgcgcccatgccgtgacgacaatcggcgagtggcggtgcaacaagcctgcaggcaataaggtatacgccgctgccgccaatgctgccatgataccccagaaaaaagcattcggcgaaatggccagatgagtaaaatgccccttggtaacaaccaaagccgtccccatcatggcaaagcaaatcgtcacaatatcaattcggcgcggcttttcgcgcaaacgcagcgctaagaatatcaacacaaccaccggtgacagatattgcaaaatcgtggcagttgcagcattggctactgcaactgccttaaagtaaatatactgcatcccgatcatgccaaacagaataaatagaattagctgcaaggcatcacgagtattccgccaaggtgctagaatcgctttacgctctttccaaaaagccacgagcatcaaaacaattccggcgataatcatcttcgaactaatcagccatgaaactttaatgccttgatcaaataaggcctcgctaattgggccagagattccccaaaagcttgaccctaaaattgctagaaaaattccccacagtcggacgcgcttcaccagtcttgctccctcttgggccgattcggatcagtcctgcatcacaacatgatcatcaattaatccggcgccttgcaaataattatacacgattaccggccctacgaacgcaaagccgttatttttcaaatccttggcgattttgaccgataaggcacttttggtcggaatttccgcacgcgacttaggtcgattgaccaacggcttgccgttcacaaaatgccataaatagtgatcaaggctgccatactttgcctgaatttttaacacagctctggcattggtaattgttgcctcaagtttcttacgattgcgaatgatatcttgccgctgcaataactgctcgacgtcttcttcatccatagcagctacttgtttaatcgcaaaattatgaaaagcatcgttaaaagcagcgcgcttgccaatgactagttcccaattcaacccagcttggaaaatctcaagggataacaactcaaataacttttgatcatcatgaaccggcacgccccattcatgatcgtggtacgcgcgcatagctggtgacattttggcaacccaatccgtataacgcttacgttcctgataccgctgcaatgctgcttctgtcttggcttcttcagcgtgatcatttggttttaccattgtccagcacctccatagacttacataggcttctcttttacggatacattacgccgcgctggcagggattgccagtgaagatgcttgcaaggcaagatcatgcgttcacctgtgcaacgctggacaggattgcattcattttaacgcgttcgcagccacagatgcctacatataagggccttgaaccgaactggccacttacactctgttttctagccgctcctgttcgcgcttaacaaaaaaaccgataacaagttttgtcatcggctcacaaacaatcacttacctatttagttttaacgatcaggacatcgcaaggtgccgtgcggttgacatattccgtgacagatccgacaaggacgcgttctacagcgttcaagccagttgcaccgatcacaatgagatcattgtgatggtcgtgcggaaaatcagttgcaattaccgtcttgggattgccaaaccgaatgtgaatatcaagatcatccagacctgcacttttggcttgatctttcaaattatctaagtattcctgtgcatcttgcgtcaactgataaaccgcatcgccggaaatcatgccgccgtaactgccaataaactgtttggtatcaagcacattcaaaacatccaagtgggctcggttggccagtgcaaccttaatggccttgttaaaagctaattctgcttccttcgagccatccaccggtacgagcaagcgatcatattcttgatccattccgctcacatccttactttctgattaacttaagcatagaacgccgaggaaacgaatacaagaaataaatttgaacacttaacatagtaatctatcgcaagaccctgtaaaataagactcaacggcaggctttactgatgcgcgtactgaatctgatcgaacccggttattatttattaaaatatgttttatttccgtgggtttatgattgatttaatacgcattaatgctatattaaagttagtgagcttgcattcttgaatttaaggattcggcgccaaaaaaaaatgaaagaaatgtggtggaaatatgattacaaatggtgttggcagcgtgctgcgacagatccgaaagggtcgcggcgaatcaatcgtcgaagttgcaaaagcaacccatacttccccagctagttttactaagtgggaaaacgatcaaacaattccgagtgaacggagtattcgcaaacttgcagaatactataatacagatccgctcgaattattgagtgtggcttatccggataaatatgctcagaagcaagaaaacgaacaaccggtcggtgatggtccatcaatccgtgttgaggacttgttaggcaacaactcagttctgacatacaatggtgttccgcttgcggcgggcaccaagtcgctggtagcggctttcattgccggattaattatcgctcagcctgagtaaagttattcttcaaggaaagccgtcatttgacggctttttttgtcccttctgatacgctcagtcgacatgccttatacacgtataacccttgaaagcaatgcattctcgctcactcataaaagcacagcctaatgcccaactagctggaaaacttaaggatgcattgccggtaccaacaactttcgcgtatactggagtcaaacgttttcatgatggaggaattaaatttggaacccaatgttcttgacattaaaaatggacttaactttcgcgacctcggcggctataagacaaaatccggtcaattagtcaaacctaagaaagtcattcgctctgctaagttgagcgagttatctgaccaggatttgcaatacctttccgattacgggctcatcgccgatgtcgactttcgctcacccgaagaacaagcagctgagcccgatcgatacccagaacacgcgacctaccattttgtgccggttttcccaacagacgaaaccaagagtagtgaacaggcggatgccttgcaaaagagcttctcacgtgatccgcacgcaggttttgaaaacatggttaaaacctacgccgacatcgtcaaaatgccttctgcacaaaaggcttatcgtcaattcttcgacatcctcttaagtaacgatgacgaaaatggtgctgttcttttccattgcacagccggtaaagatcgaaccgggatgggcgcggtatatctactttcagccctcggtgttgatggtcataccattcgccaagactacctcgcgacaaacgatctcattcagccgatggtcgaaaagaatttggcagctgctcgtaagcatggcgcaactgatgctcttcttgccaacattcaagatctcggcacggtttcgggtgcctttcttgacagcgccttagccacgatcgatgctgaatatggtagcatgcgcgactatttgcaagatgaattaaagctgacccccgctgaaaaacgggatctccgcgaactttatctacagtaaaaagctacatgaatgagtcataacagttgatggttcaatcagacaatatctttgagcacatctatcaagaaactgggaaaacacctctgttgagtcccgcaagcgcggtgttctttgacaggcgatgtttcagtcccagtttctttttttaatcggcatctttgcgttcccactctaacttggctagaataatgacatcaatgacgttaagaggtgaccgggatggatttaaaaatgatgattaaagcccatgctaaagagttgggaatcgacaaaatcggctttacgaccgctgataattttgccgcgctcaaacctagcttgctcgcacaaaaagcggccggtcacacgactggctttgaacatcaaaatatcgatgaacgcctatatcctgataaaatttttgaccagccacaaagtataatcgcaattgcgttagcgtatccggctaaaatccatgaacgaccgccgcgaacaggacccaaacgtggccgatttgcgcgggccagctggggcattgattatcacactgtgcttgatcgaaaaatggcgtcacttatcaagtttattaaacgaacggcagaaaatgatcctaacttgcgtttcaaacccatggtcgatacaggtgaattaatcgatgttgtcgttgcgcaacgcgccggcctcggctttatcggcaaaaacggtctactcatcacccctgaatttggttcgtatgtgtacctcggtgagatcattaccaatattaagtttgcccctgacgaaccgatgacctcacagtgcggtgattgtactcgctgtattgatttttgcccgccaaaagccttgcttggtgacggtcgcatgaatggtcaacgctgtctttcctatcaaacccagactaaaggctacatggatccagaatttcggcccatgattcgcaacgtcctatacggctgcgatatctgccagcaggtttgtccgtttaataaaggcaaggattttcatatccatccagaaatggaacccgacccggaaacggtattgccggaactgattccaatgttaacgctgaccaacaaggactttaaaacgcgctttggcaaactggccggtgcttggcgcggcaaaaaaccactgcaacgtaatgccattatcgcactggtcaacctgcatgaccgcagcgccattcctcacttgctcgaggtcattgagcatgatccgcgaccaatgattcgagcaactgcagcttgggccgttggtgaattacagccatcgtctaatcctgaaatcgagacttttctcaaaacggccttggcaaaagaaacgacgccagaagcgcaagtcgcctttcaggatgcacttgatcacctaacccaacattgagcatgttataatgactcttaagaatacgaggtgcctatattgaaactatatcaaggactcactcaggtgcaggtcaatgaagaaatggccgatgatacacctgacttcaccattaccaccgatctaaccaaaccgttgcactactcaccatcggaactttaccactacttggatgcggtcttaaaacccggtagccggcacgatcagaataatctgaagtatgtcacggatgctgccttcatcggcgaaaattttgatttcaactcaatcccttacactgctaagttaaaggattttgaagaaaaaatggcatttgctcgcaaccttgtcagtgatctcaatcgtcacgtcagcgtcaatctgaatacaaaaaatcatacgtttgaacttttattcgttgattaagaaaaaataaaaaccgttgttcgggaagttttccccgacagcggttttttgtactttcaatttaagcaggaatctgctatctagcgcaaggccgggatcacagctgtcaattgttgaacaaccaacacactgagcgccatcttgagcaagtcaccaggaatataaatcaagacactcgcaagcgctgggacaaagcccaaactggtagtcgcagctaaccacgcggcaccaagaaattccgtcaaaaggaccccaccaaatgtcatccccagtactttggttaaccaaaaatcaggtttcagatagtgcgttatggtcgcatatgctatcggtgtcaacaaccagccgtacatgaaaccagcagtcggtcctaagaaaatagcaataccgcctcgaccgcctgtcaatactggcaagcctaatgctgccaatgccaataacataccaattgtgatcgttgctggccgcgttggtaacaacattgcaaccaacataacacccatgttctgcaagacaatcggcacaccaagaaagccaacagtgatcggtggcgcaaaggccaagccaatcaaaactgccaacaatagtcccatccgtgtcaaagtttttgtttgcatgaagtcaccattcccatcttatgttttacttaggataccatatcgtgacgccatgcagtaccaaaaatcgttcagggcatgtctcttttgtgttcttttgccgaaaaatcgcctttttgtggctaaaatacccgattgttacttttcttcggtcaatttaccttcataagccagtttctcgttttcgtagcccagcatgtgatcttcaaaatgatcaattttatagtctaggtagcgaagggtcttgttaatattatcgcgccgttcaatcaaagcatcgcgttgttcaataaacaaagactttcgggctgcaattgtttgatcgccttcccgtaaaagcttaacaaactcggaaagcgattcaatcgacatcccagccttacggagaaccatgatgtaataaacccagttaaccgcatgttcatcgtagtcacgataaccactctgattccgttgaatttcaggcaataacccaattctttcccagtaacgcaatgtatcctttgtcagattaaactttttactaacttcatcaattgtcacgcttatcgctccttcaacagtctcagcagatcaacgacatgattatctggcattcacccgcaaactaagttcagtggtctaataccgatcacaacggatttttgactcagatagtcaaatgatcctttgcatgatgtgactcaccatgagctccaatcaatacctgataaacctttgtccaagcatctcaaaatttttagcacaccaagacgtttctacaacgttgtcagccatgcagagattttggccttcttttgggcgacattgtctcccgccataccaaatccttgtttgacttgcagttgcccagctgcctgtttaaacgcctgttcataggcgccgggtgtgccagcatcggtataaaaaggcctgaatacagctcgactgccttgcacctgttttagaaaactcaaaactggtgttgatggcgctgccgaccaaaccggaccaccaaccaagatcgtttcacaaccggtcagatcaggaataaccgttgtcagatgcggtaaatttccggacgctacttggtgttttgcccgaccagaggtgtcatacatatctgacgaaaaagtttgctcaggaacacgtagagctaacaggtctgcatctgtcgcctgttgtaaatatttcgccaatgtagcagtatgccctgaccatgaataatacacaatcagtactttacttgccatgacagtctcctttaaccttcaaccacgattagtgacttaatggccttccgctgatccatcgcatcataagcgtcttgaatatgttcaagatcaaagcgttgcgtgaagactttgcctgggtgaatctcgccattcaagacggctttgagcagcaattgtttgtcatctgtcgtgaccgaagcgatccccccacgcagaccaatatttcgccagaacagattattcgtgttcatctctggcttttgaggtacgccgacacgacccacaactgcgcctggacgacctactttagtggcagtatccactgactgttcagtgccaacacattcaagcacagcatcagcacctgcgccgttcgtcattgctaagactttctgaaccgcttcatccccacgttcgggtacaatatcagttgcgccaaaagcaatcgccattttttgccggtcttcatgccgactcatcgcaatgatgcgcttagcaccgcgtaacttggcagcaatgacgccgcaaaggccaactgccccgtcgcccatgacaacaactgtatcgctttgtttaacctcggcgcttgcagcagcatgataacctgtcgccatgacatcagccagtgtgacaaatgaattcaacatctcatctgaataatcgctcggctgacccggaattttaaccaaggcccagtttgcattcgtgaaacgtaaatactgcccctgatagccaccattgccgcctgcttcctgattcaggcaatcaccatcaaaaccggcaaggcaagccgcacagtgaccgcaaccatgtgtaaacggcgcaatgacaaaatcaccgacatgaatatcatgaacttcagcaccgacttcttccacaatgccaatcgcctcatgaccaacaagactattagcgtctcgatgtgagatgccgcggaaccaccataagtctgatccgcacacactggctcgaacaatcttgatgattgcatcagttggcttttgaagctgcggttttggtacatcttgtgtttcgactttacctggttctaaaaaaacagctgctttcatttgaaatacctcctaaatgtgagcgcgagccagcacgattagcaaccggcgtgtaagtgaccttgggcgcgatggtcgcactttgaccattgcgaacaaggtccttacacacagattgctgcgctggcgagcgcgttatcgtgagcgcttttccccagttaataaaccggtcgatctgatccggccgtatcaggatcggcaatcccgacactgtcgtttttcaaataatcaggatccgcaatgatcttaagcaccacgtcggccacactcttgcgtgaacccgaaactccgacataagtttcatctttatgcgtcagttgatacttaacgtcacgatcatttagccaaggtaggcgtaaggttgtgtagtcgagacccgactgttcaagaagttgatctgacttcagagctgatggtaacccattgccgatagtcgccttgttccacttgccaaaggtgcctggaacttcgtcataaaccccgagaacattcgtataaatcacccgctgcacatgaccagccttcatccccgcaatgacattttgggtttgttggctgcctttgctatgatcaaccacgccgacaaatacaaaatcctggtcaaccattgcttttttgacatcatccaaccgatcaagactgccctcaaccagtgtgacccgcggatttttcgccaactgcgccaagcgtgattgatggcgtaagaacaaggttaaatgtacattggcgaattgatcatcgttgagaatttgattttcaatcagtcgtgaaatctggccgtttgcagccattatcaaaatattttttttcaaaacatcgcctccatgtagatgtgcatcacttgcttgagttttccccgtaaactgatatcgcagtcatcactgccgaatcagctatagggggatcaccccagtcaagaaaaacgttatctgtatctaattcgtttatggctgaatcaataaagatgccatgatcgtggccaagttgcgttatctaaaccttacttcttacgaacaaaggctatattaaacctttgtgtgcactccaatgcaaccacaatcatcatcattgtttcgctaatgaatgtgttgttgtcgctcaatttacgcaaactcaatccagaggctaactttggcctgttgtatgccacacctaccgtaatcgtcgcccttgatttattgctcaagctagtcggtctccttatttctgtgaccattttcccagccgcaatggtgctgtcaatcttattggccagccttctattgattttctttccaaaatcagcatgaaacaacatggcactttatgaaaatttgcaaaaaaatagctgtgaacgaaatttcgttcacagctttcgactgcccaggctggattcgaaccagcgaccctttgattaacagtcaagcattctaccactgaactactgggcaatgagtatgtatagtatattctcatgtttcttagaaaaatgcaatatttttcgtctttcttttttgccatttccctttaaaaatttaaaaatagttttgacgtgcgcagtatgaccacaaaaacactgacagtctttggttatcgctcgatgaacctgcatagtgcccgtgaaatggccgcacgctgacaagcagtttcatctataataaaggtgaaaggtcgtgaacctatggatgctccttacccgaatatgcaagatctgcctgatttgccgtctgaatccggcaacgatcaaccaatatggcaagcacttgccaaaaaaataccctcagttgccgatcgccgtgttctcgtcattcattgcggcgatggttggttttgtcgtcatgccctcaacggcggtgccaccgcggttctcggtattgacaccgatgcggttgccattcaagatgcccgcgctgttgccagctccgatcgcttacgttatcgcatcatgccggataaatggctaaaactgttaactggaccatatgatctcatcgtcggctcatttgatcaatcaccagaggagctacgtgccatgactcatgttttaagtgcgctgcttagtcctaaaggccaacttatcgccgctgttgcaccatcaaagcagcccattagcgatgatctcgcagttgatgaactgatcagctcacaacttgtgatcaatcgttggtaccaagtgacggataagcggctcacccaaacggaacaattatatctgttgcttagctcgcgggtttcgcactgacatctcaaggtgagcaacggtcattgaccactacaattaaaatgagcacaaaaaaagccgaagcacttgctccgacttttttgatgcattcatttaattactgaagtacttcaacggttgcggacaagatccctgctgcaggaatctggccactcggcattgcaacatctaactgattaggattgcctgcagcaaaactaccagtatcattaactgtccgagtcaatgtttgaccattggacatggtgatacgtaatacggtgcctttagggaagacgctcaaattagcagcaacgccactgtagcccatgttgctacctagaacagccggatcatagaagctgatcttgaaggtgcctttgttagttgcactttgggttggttgtgacgtctgagttgtctgagcaactggttggctaaccgcctgctgttgtacttgttgttgctgcttttgttgcgcagctgcctgctgagcctgttgctgttgaacttgttgctgttgtgcttgctgagcttgttgagcctgttcagcagcctgttgttgtgcttgctggttagcggccgattcagcagcagcttgaactgacgcagctgattcagcggcagcactttgcgcggcagcactttcagcggcgctttgcgctgctgcggacgcagcggcactctgagcagcagcgcttgatgctgcttgcgcattagctgacgcagttgcggcctgagcagcttgttcggctggtgacgttgtctgagtcggtgcggcagccgcatcagcctttttcgtcaatggtgccaactgctgcaaagtattaatactcagatagcgttctggaatccagccgtggtcttcagtttcataccaaatttctgcgaagacttttttactattcacaaatttaacgtgttcaccagttgtcacataacgcttaacttgttgacccgctgtcggtgaggtccaaacagtcgtagcaccaccgttgtaggtaacatcagcttcggttttgtcgctagctggtgcactgacggtcgcggtttcagtattcttcgtagcagcgctgacgtgacttggcttggacaatgccacggcagacagtgcaactgctgagaataatactgtacttaaaagctttttcatgttcgtattcctcctgggtttgtgtggtgatttaactaactgagacttagtatagctatccagtgttacgaacatgtattctgtgtgttgcgattgggttaagttctatgacaaaagattacattagatgacatccttaacaaactgacactgtctttttgttaaaccaaactaaaacggcatctctgtcaaacagatgccgtttcacttctataggaagagtcgatccaatgttgctgccaaaacctgatgtccgtgatccagtatccccggattgacggggccttgcggtttgcctgctgccgcaccaatttcagcaatcatgtctggggtcacttccagatggaactggaagccaacgatatggtcatgataagcgaagccttgcagcgcatgctcattttcgtaaagtaatgtacttcctggtaagcggctcatcgcttccccatgccagtggaaaacattgagtaacgtgccatcggtaccgcgcacggtgccgatgccttcttctggttgcggcattcgataaacattggcaccaaatgctttggtaatctgctgggcacctagacaaatccccaacaccgggcggcccaatttattgaggctgcggatcaaaattcgttctgcggcgagccaatcaaagtcatcattgacgctcatgggtccacctagcaaaatcaacccatccatctctgctgggttcagttgtgcaattggatccccttgatcagggcggtaagtgactatgtcaacttgcttgtctgcggcccagtctttaatcgtgccaagatcctctgtatcagtatgctgcatgactgtcagcttcatgctgtcgtgctcctttcgtggccgcttaatcttggcctttcaacgctgctgcaaatggcttgattgtggtcattgcgggatcataaatcgcaaagtaaacccgcttaaacgccccttcaaattcgggcaataataacgcttttcgaaacaacttggcgactggtgcaactggattgccaaatacgccggttccaaacgcgcctaaaatgacctgatcgacatcatgcgccttaaacgcccgaagcgtctgcagaattttaaacgcgatatcgttcatggcagtggcatcatctagcgttgcatcaattcggcgattgggtgctgcgacggtgacaatgtcgacatatttgtctgttaatcgccgtccttgatcatcgaaaagctggcgaacatgttctgcatagatcaacttctgactaaaaagcccgcgatttggcttgcgacgattaagctcataataatctgccatgtgctgctcaagggctggaaccaaataagtccccttggcaatggcttcttcctgcgcacgtgcgccaactgcaaccccgccgtctggatcgaccggacttgcaaaattcatgacgccgattttgcccgtcagttcactcatcaattggaaaacatcaacattgcgcaaggcaatttgcggcggttctgtccctttcgctggcgtttgcggcaatggttcgctaatgacctgtgttttgggcatttctggtcgtaccttaaatgctgccattgtctcttggtacatcttgacttgttccattcctgccaccttcaattaaatattttcgattgacctaagcataacatagaagcaaagtgatggaattatcggtcatctttgtcattcaatgttaaaattaactttgtacgatacatgaaatgaggaatggaatacatggaaagtggccaaatcgtccccaatttattggtgatgctcgtcacctttttattcgcggcattttttgtcgcgtgtgaatttgctctggtccaaagtcgtccaagtgccttggaagaaatgattgataatggtactggccgtaaagctaaagtcgagcgggctttacgaatggtgcataatctaaacgagtatctctcaacgacacaggttggtgtttcgctggctggcattatccttggttggatcggggaaacaaccgttgagtttttgttggttgatctttttggcttgacccacctgagcttgcctaatggtagtctgcacgcagttggcgcgattttaggcgtgattattttaacctatttagaagtcgtgttaaccgaaattgttccgaagaacatctcgattgattatccgatcaaaaccttgatgctggttgtaacaccgctacattatttccatattttgttctatccttttgtttggctgctgaatgtcagtgccaccgggattgtcaaaatgatggggatgaagcccgcagacgaaggcaacgaggccttttcgcaagctgagattctgagtctgagtaaaaatgccgtcacaactggtgacatggagcaaaatgatgttatctacatgcagcgggcatttgaactgaatgacaagactgccaaagacatcatggtggatcgaaccagcttgtttgtcattgatatcaccaccaccgtcaaagaagctttgcgggattacttaacgcaaggttacagccgattcccggttgttgcgaatggcgataaggataagattctcgggtatgtttacatctatgacttggtcaagcaaggtcaagttgacccgtctgtgaaggtctctaagctgttacgttccatcattaatgtgcctgaagtaacaccgattcatagtattctggcacaaatgatcaagaaacagacgccaattgttgtggtcgttgacgaatatggtggtactagtgggattgtcaccgacaaggatatttacgaagaactatttggtaccgtcaaggatgaaattgatgatgtctctgatgaatacattcggcaaacagatgatccaaaggtcttccgagtcagtggcaaaacaaccttgtgggattttgaacgttacttccacaccaatattaaagccttcactgattcagaaatcatcaccattgctggttttatcatggaagatcatcctgatttgaaactgcacgataaggtcaagattgatcatttcaacttcaccgttgctgatttttcccgcggctttgctaactggtttgatgtcacacaagatccaaaaccagttaaacaaacggttgctgaagaggttaaagaagctaaaaacgacgataacaagcattaatcaggatcaagctaaactttcaaaaacgtggtactcgttgaggggatcacgtttttttatcgtaatctatttttgtgcaataccgctaggcgcaactaccagccgataaactaaaccctaatgacagcaacgatttcattatttacccaaagccgttgaggacgtgctagactggattataacgattttaagaaaggacacgatattgttgacaacaacagacgttaatggtcatccatataatcgcttgctgcttgtgattaccttgttgatcggtacttttacaacattcttgacgcaaacgattttgaccacggcttacccgacgctgatggcggactttcacatcagcgcgagtgcagtccaatggctgaccactggcttcatgctgattatgggtattatgatcccagtttccgcatggctgctggacaaattcaatgttaagtatctctacttaacagctatgacaatctttttccttggttccttgatttgttggttagcaccagattttcaagttctgctggctggtcggctcacgcaggcaattggcgttggtatgtcaatgccgactttccaaacagtcatgttcacgattttcccacctggcaaacgtggtagtgccatgggcctagctgggattgttatcggtctagctcctgccatcggcccgacgctttctggttggattctgcttaatcatacttggcgggctttatttgccgttattatgccaattgctgctggggtcgtgctgctggccatctatagcatgcgaaaagttttgccgacctcgaatccaaaaattgatattccttccattattgcttcgactttgggttttggcggcttgctttatggcttctccacagttggtgatgctggttggaccgattcccaagtactgattagcttagccatcggcattattttcgttgccttattctgcgtgcgccagttacgcctcgaaacgcctctgctagaattgcgggttttcaaatcgcgcacgtatacattgagcgtcattttaacagcggtggcgtttatgtcgatggttggtgtagaaatggtcttgccaatgtacatccaaacgatccgtggtgaatctgcctttcactctgggatgatcctttttcccggagccatcatgatggggattatgagtccaattaccggccggattttcgacaaaattggggcaaagcggctggctgttgccggtctgttcctgctagttgccggatcgctgccgctggtcaccttaactgctaacacgccgattatctatatcacgaccatttacacagtgcgcatgttcggcattaccatggtcacgatgccggtcaccactgctggtatgaacgccttgccaacacacctgatcaatcacgggacggcggtcaataacacggttcggcaagtcgccgcctcaattggcaccgcaatactggtgtcagtgttatcagtagtcactaaagatgcaacgccagccgctagtggtcgactgcttgacccgatccattacaccaacgctatgaacaatgcagtcattgccggttatcgcgcggcttttgccgtctcactagtcatggcagcgcttggtctcgttctcagcttatttttgaaaacagacgtcattgatcggagggacgcctcatgattatcttgctattgatcgtcggtgcgcttgcctttttctgggctgttgtgttaatgcaaccaagtcggcgccgtcaattaacgatctgggtaagcgcgggacttgtcttggcccccatcctattgttaagcgtgaatgacctttatcacgttggcttcaacattgacgaaaccactgaactgcagccattagcaccgatggacgaccagttgcaaatttcgcggcggcccattggcacagcaaaaaagcatttcagctatcgttaccttatcatttccgatgcaaccgttcataccgctacacctagtaccacggtctcaactcgcatcgaacacggcaccattccgcaagttgcagtgacaactcagaagctgacttatagcaatgcgctaaccgctattttgtttgctggatcaggcgaacaaggtaaagcaattggcaaaatttacaccttcacactgccagcaaattggcagattgttgatcagtaaacgctatcttgcactcgcagaaaccgattcacgttccgtcatcacgcactcgccagcacaaaaatttgaagctgagccatacacttatgatttgttagatctcaattgatctgagtaatgggtctggcaaaaagtttcttgccgtgccaaactccgcaatctccggccagctggggtggcgacgcgaagctagagcggagacggcgcttcgagcccaaagaccggtctcgaagtcgcctaacaatatcagcgccaaagcccgtcgctgtgttgtttgcacggctgagccccatctggcctacgattgctacgctttggcactgaaatctctaaagtccaccctgcgctttctatcaaactacttagcgctaaaaaaagtctgacgttcagcgaaacacttcatctcgctgaggatcgtcagacttttttgattgcccgtatttattgcggttcagccaacaacatgcggtacaaggtgctgatgggcaggcccatgacattgtagaaatcaccgtgaattgacttgaccagtagtgctccggcatcctgaatgccataggcgcctgctttgtcttggtaggcgtcttccgccagatacgattcaacatccgcttcacttagcggccagaaggtaacatcagtcgtcacgacctgctgccgtacgctaccattgtccaagcgcacccacaaaccggtataaacctgatgtgtctgaccacctaatgccgtgatcatctgtttggcttcggcgcggtcatgtggtttgcctaataacttgccttgaaacgccaccatggtatcggcggcgataatcgttgccccggggtaacttggtacaagtgattgtcccttagctgtcgccaagctctgaacatatgctggcggatccaacactggcaaagcgcgttcattgatactggcaggatggctttcaaagtcaggcacaatccgctttaacaattcctgtcgccgtggtgaatgactggccaaaatgatcatgcttgcatttccccgctttcgtgactgtcttgaatccgtttgaacattttctcaagatcggtgtttgaaaagtgaaccaagaccggccgaccatgcgggcaattgaagggattctcacattccggcaacttctgcaataatgctcgcgcctgtctgtcgtccaaatggtgattggctttaatggcacgcttacagctcatcatgatagcagttttctcccgaaacgctgcgactgtcatgcgaccatcacgcaaaacccaatccaccatttctttaatggtatcttcttcctgcccagctttaaaccaagtcggatgatgttcaacaacaaagctgttttggccaaaatcttccagatataatccaaccgactcaagcacgtcccgatgatcacgaatgctaatggcatcagccgcggaatagtctaacacaatcggtacgagtaaatgttgttggtcgttgctgacttcgccaatagcttgccgataatactcatagttcacccgttcttgcgcagcatgctggtccaaaatatataacccatcgcctgattccgctagcaaataagtgccgtggacttgcgccaagtacgtgagatttggaaaacgctcagctgattcaacatgcgaaatatcaggttccggctcatctgccatcaaggttgggaccacattcgaagctagccgctgataccgctgatcccatgcagccagacgttgcggttcgttaaaaatcggctgatcatccaaatcgccaatctcaagatctggtgaagttggtgccggtgtcggctcctcagcagccgtgtctgccaagttagtagttgtgttttcgcgcaactgttgcccttgctgcggctgaactgagggcatcgtcttgggactgatcttattcaatgtcagttccagttgatccagatcataccgttctctttttggcagattatcgagcgcatccggaatcagattttccttcgccaatcgtgttcgaatcgcctcgctgagcaaatgactaagctgatcttccttgctcagacgcacctcggcttttgtcgggtgaacgttgacatcgaccaacgcagcatccatctcaatgttgatgacacccattggataacgccccaccattaacttcgagccgtaaccggcaataaccgccttagtcagttggaagttcttaatataacggccattgacaactaaactcaagtaattacgcgaagctcgggtcgtttcaggcaaacttgttaacccgctaacccgaaaatcaagatcttgtgctttgaaatcaaccattgagcgcgccacagacaagccataaattccggccagtgtctggcgcaaatcaccttgaccagctgtgcgcaccaccatattgccatcatgtgaaaccgtgaaggcaatatcaggatttgccatcgccaatcggctgacgatatccacaatttttcccagttcagtttgctgcgacttcatatacttcagccgcgccggtgtgttgaagaacaaatcattcacttcaacatccgtaccgcgtcggtgagccgctgtcgactgcgcctcaacctcaccgcctttgacgtgaatctgggtgccaatccctgaatccattgccgttgtcaactttacgtcggcaaccgcggcaatacttgccaacgcttcgccacggaagcccaatgaatgcacattaaataaatcacgcgtcgtcagaattttactggtggcgtgccgcaaaaacgctgttgcaacgtcatccggggcaatcccgatgccgttatcgctaacccgaatctcctgcaaaccagccgcggaaatcaggacgtcaatttgcgttgcttgtgcatcgatactattttcaaccagttctttgacaacactggcagggcgttcaatgacctccccagcagcgatctggttgcttaatgttgccgatagttggtgaatctttggcataaaatcacttcttctttaaatgcttctgcaggtcaaatatgaaattcatcgcgtccatcggtgtggccgccatcaagtcaaatttcgcaagtttcgtcagaatcggactattctttggcgtcggttttggttcttcaaacaacgacaattgttgctcttcaacttgcggcgctggtgctggcgccgttttattgggtgcatcggcttcaagctgtttcaaaatcgtatcagcacgcgctaacaaatctgccggtaaaccggcgagcttggcgacgtgaatcccataactcttatcggcaggtccaggcatcattttgtgcaagaaaaccagattgccatgctcctcaacggcaccaacatggacattctttaacttcgccaaggagtctgacaaactagttagctcatgataatgcgttgagaacagcgttttggcgtggacatgatcatgcaaaaattcaataattgcctgtgccagcgccatcccatcatacgttgccgtgccgcggccgatctcatcaaaaagaatcaggctggaagccgtcgcgtggcttaatgcagcgttggcttccagcatttcaaccatgaaggtactttcgccattggcaagatcatcagccgctccgattcgggtaaagatctgatcaaaaatcggtaagtcagctacatctgccgggacaaacgaacccgcttgcgccatgataacaatcaaggctaattggcgcatgtaggtacttttccctgacatgttaggcccggtgatcagcaacatatcggtgtcgtgattcatgatgacgtcgttaggaatataactgtctcggccaagtacatgttccacgactggatggcgaccacctttaacattgatatcatgggttccggcatgcatcgttggtcggacataatgactgttttcagccactgttgcaaagctttgcaacacgtccaaagatgaaatctgggccgctaaagcttgtagtcgtttgatctgggctttgaccttgtcgcgaatgtcttggaaaagatcatactcgagcgctgttgagctttcctgcgcttcaagaatcaagatctccttttctttcagctctggggtgataaaccgttcagcgtttgtcagtgtctgtttgcgttcatagcgcccttccggtattttgtccaaattggacttagtcacttcgataaagtaaccaaaaaccttgttgtaacgaattttaagtgtgtgaatgccagttgctttgcgttccgatgcttctagttcagcgatccattgtttggaattcttcatggcatcacgatagctgtccagtttttgattgtaccctcggaggatcaagccaccgtctgtcactgaaatcggcggttcgggttcaatcgcacggcgaatcaatccggcgacatcgctgactgggtccattttactgcgaagtgccttaaaactgccatcatcaagcttacccagcacatcctgaatagccgggatctgatccaaagaggtttgcaactgaattaagtcacgaccattaacggtaccaaaagcaactcggccagctaaccgctcaagatcatagactttagttagtcgttcctgcaactcactgcgttcaaaaaagtgatccaataaatcctgaacctgattttgccgcacactgatcgcatcaatatccagtaatggtcgatccagccattgtttcaataaacggccacccatcgctgttttggtcgaatcaagcaacgacaacaaggtgtcacctttgcgtcccgttctgctgttttgcaaaatgtcgaggttgctacgggcgtcctgatccatttccagataggcggaaggttgataagcaaccgctttttgaatatgggccaagctgcgtttctgcgtgttcaataaataggccattagcatctgcacaacggcagcctctgcaggatcagttagctcctgtgacacataactgccttcactcgtcggctcggcatccggttggactgacagaagccgttccccttgcttgagcattcccgcgtcgtcatcggtcaattcctcaggcacaacgatttctttggtggccagcgcactcagttcgttttgcagagcaaatttgctttttagatccgtcactttgagctcaccggtcgatacatcggcatacgcaaacgcataacctgctgcatgcggcatcacagcggtaatatagttattcgacttggctgcaccggctttgatgtcaacatttgtccctggcgttaccaactgaatgacggctcgtttaaccatcccgacagcttttttaggatcctccatctgttcacagatcgcaactttgtaaccgtggtcaattaaaatatcaacgtaactttggacagcatggtgcgggacaccagccattgggataggatcgtcagcactcttgtttcgtgcagttaatgttagttcgagcaactgagcacctttgatggcatcatcattgaacaattcataaaaatctccgatgcggtaaaacaaaaacgcatccggatattgcgccttgatttcgttgtactgctgcatcataggcgtttcactggttttttgcggcacgaaattcacccttcgtcctttgactttctttgacgttctatatgacccattttaacaggtgcgtcaactttgagcgaccccctggcaagtgcaaagagtgagttgtcgcggttagaaatcgaagcatcggtaaacttgaagttaaatggctggttttgagccatttagcttcaaggttcttatgtacagatttccgcggctgcgtatacgttcaaatcaaaaaacgatcagatcatcatgatctaaccgtttggcaagtagtctccctacttcttcaaatgataactgtaagtggcaatgatgacattctcgcggcttgcaaaggctgcgcgcaggcggaagttggtttggttgtgaagaatattctgccattttttacgtggtacgaactgcggaatgagtaccgtggttgtaaagttccgtttggcggcgttgcgcgcgacgatgtcaacgaagcgaatagttggggcttcgatggaacggtatgatgagtggatatcaacaaatcgcacctccggaaaatccgcgcggaattcgctttgggtttctttttccttattgggattctcgtccatcgaaacgtgcatagcaatgacatagtcgccaattgactgagcataatttaaggccgcgcgcgtaacccgagtgacattaccgaccaaaacaatgacggtgctgccatcgtaatcatgttgtgccacttcgaccggcaagcgtaattgctcagcaactttgtcataatgatcgcgaattttataaaacatgaaaatggcgagtggcatcacaataaagaatggccagatatcaagcaatcggtaagcaaacaggatgacgagaattgcaaaggaaatcaacgcgccagagaagttagcaatcgttttgccaatccaaccttttccgcgatgacggaaccaatggataatcatcccactttgcgacaaggtaaatggaatgaacacaccaaccgcgtacaacggaatcagccgttcagttgatccttggaaaatcgtaatcagcgccgcggctcctaacgccagtgtcaaaatcccgttagagtaacccaagcgatcgccacgatccagatacatatgcggcataaacttatctttggccaagttaaaagccaaaactggaaaagctgaaaatccggtattagctgccacagccaagatcaaggcggtcgcaaattgaacaacgtagtacatgatacctgctccgccaaaggtctctttggccacctgcgaaagcaccgtcactttggccaccggcacaataccgtaccaatagttcaaaaatgtaataccagcaaagaagaagccaaggatggcagccatgatggccaacgtttttgccgcattcttttctttaggcattttaaagaacggcaccgcattactaattgcttcaaccccagtcagtgaactggacccactggaaaatgcccggaagatcaaggccatcgagactcccggaatcgctgcaccgacaaaggaagttgccttgtacggaatagcgcctgttgccacttggtaaagtccccagatgatcatgcccgtcatgacgacaacgaataagtaaaccgggaccatcaaaaaattggccgattcactcatgccacgtaaattcatgctcatcaagatgaaaatgatgatcagtgaaatgatcacctgcttgccataaagcgcaggaattgcactggtaatcgcttcagcacccgcggaaactgagactgaaaccgttagcatataatcaatcagtaatgaagcgcctgcggttaggccggcatttttacctagattttcgctagcgacaacatacgcgccgccgccactaggataggcgtgaataatctggcgataggatagtgtcaatgaaatcaagagcactaaaacaaaggcagcgatcggcaatgagtaccaaatcgcagccgctgacaatgtcgtcagaactaagacaatttgttcagtcccgtaagccacacttgaaagcgcatctgacgataacatcgccagtgccttgaaaatgttaagcttttgaccgccttcctcagaagatttcagtggtcgcccaataaacaggcgctttaaatgcatcattttcattactcctatatgaaccgaatgtatcgggaaaatttaaccaaaacacaaacaatcatcagtgtaacctaaatagacgctcaagcctaccttatctaacgcaacatgacaacttggtgagattccctgacgaaaagccccaataatatcgtcctaactagcatgatgtgcaaaaaagcaaaaacggccaccttctcggtgatgcccgggaaagtggtcgttttcgttacgccttttcgataatcacaacatcatggaccttcaacttgcgatgaacctcgtgctcgatctcgcttttagcagcgtggtcaattttaaggtcagctttaggcgtatcaggcaacagtttttccaagacaaaatcaatctcagcatctttaatggtgcgtttgtcgtgggtcaagacgacatcgacttggtcaaatccttcaacgtaataaacatgaacagatcctaacgtatataattcaaaaaacttaaccggctttcgattataaagataccgcattgtattcggtaacattttgtgcaagctggcgttaagccgaatgggattttgaatcagcttcatcaaatcgcccctttttttgtgtgagcgtgagccagcgcgcttagcgaccggagtgtaagcgggcctgaacgtgatggtcggtctttgaccattgcgttcagggtccttacacgcaggtcgctgcgctggcaaacgcgttatgactgagcgtgagcttgcccggttagaaaccggagtataagtggcctcaagtgcattggccgagctttggccagtgtgcttaaggtcttctgggcaagcgaacgcgttatgaccgcgacatcgctttgatgtccacggctgatgatcttactaattaaccatcatacaacatgaaactacctttattttaccaatgaatgccccttagtgactaatgattaggcacagaaatgttaattaacttcataaagtgaccctgaaaacttgaaaagcacactatgtaaacaacaaaagcaccggcgcataagccagtgctcttgttgaacgaataggcagaaattacatcataccgcccatgcctgctgctgggttagcaccagcggcagcattattatttgcatttggatctggcttatcagcaacaacggcttcagtcgtcagcatcaaagcagcaacggaagcggcgttttgcaatgcagaacgggtcactttggttgggtcaataatacctgacttagccatatcttcccattcatcagtagcggcattgtaaccaacgccttgcttttccttcttcagctgttcaacgatgacagaaccttctttgccggcgttctcagcaatctggcgaacaggttcctcaagcgcacgtagcacgatgttgatcccggtttgaacgtcgccttcttctttcaaagcagcaactgcaggcaaaacatctaccagagctgtaccgccgccagcaacgtaaccttcttcaaccgcggcacgggtcgcattcaaagcatcttcgatccgatacttgcgttccttcaattcagtttcagtagcggcaccaaccttgacaaccgcaacaccgccagctaacttagccaaacgctcttgcaacttttcacggtcgaagtcactggtcgtgtcatcaatttgcttcttgatgatattaacccgttcagcaatggcatccttagagccagcgccatcaacaatcgtggtgttgtccttggtaaccgttaccttgccggcgcgacccaattgttcaagcttggtgtctttaagatccaagccaaggtcagaactgatcacggtaccaccagtcaaggtagcaatatcttcaagttgagccttacgccgatcaccaaagccaggggccttaaccgcaacaacattgaaggtaccacgaatcttgttcagaactaaggttggcaatgcttcaccagcaacgtcgtcagcaatgatcaacagtgccttaccttgttgaacgatttcttgtaacagcggcaaaatgtcctgaatattggaaatctttttgtcggtgatcaagatataaggatcgtcaaggtcagcttccatcttatcattatcggtaaccatgtattggctcagatagccgcgatcaaactgcatcccttcaacaacagagagttcagtgtcaatccctttgctttcttcaatggtaatcacaccatcgtggccaactttttccatggcgtcagcaatcagactaccaacttctgtatttgaggaagaaacggacgcaacctgcgcgatttctttcttaccattaactttgtggctaatcttgtgcaattcgtcaacggcagccttagttgctttttcaatccctgtgcgaatgccaacaggattagcaccggctgtaacgttcttcataccttcgcggataatactttgtgccaaaaccgttgcggttgtggtaccatcaccagcaatgtcatttgtcttggaagcaacttcggcaaccaacttggcgcccatgttttcgtagtgatcttccaagtcaatggacttcgcaattgtgacaccgtcattggtaatttccggtgagccatagctcttgtccaaaacaacgttgcggccttttggtcctaaggttgtcttaactgtgtttgccaactgatcaacgccgcgcagcattgcagcacgtgcgtcttcagagaatttaatttcttttgccattgtttttattcacctcaaaattgatcgattatttagttacgcaattgccatgatgtctttttcatgcaatacaaggtagtcttgaccttcatacttcacttcagagccggcgtatttgtcgtataatacagtatcgccaactttgacggccattggcaaacgcttgccttctggtgtcaaagcgccttcacctactgcaacaactttgccggtttgcggcttttgttttgcgttgttggctaaaacgatgccgccaactgtctgctcctcttcttcaacgacctcgacaatcacgcgatctcctaatggttttaacaaggcaatccctccacattacattttttgatttagcactcgttatgtctaagtgccaactacagaagtaactataacgagttttgcggttgaatgcaaccccaaaccgtggaatgttatacttattccagacatttttttaaaggagctctttatgtcactacaaaaacatggactttccattattggtgcctatttagtggcgctgattggtaacttgctgattttccaaatcttacccgttggccgactcagcttaggtcttgctactgtgatcagtgtgctggcgatgattgccgctggtttcagtgagcggcagttagtcattgccaacgccatcgaagaacctggggttgccgccccacaacaacgggttttctggggactaatcggtattgttggcattttggtcgctcagcttgtgggttcatggctagaaacatttttattcaaaataccgcaaaccagcagcctgattcatcagcagctgtccagtatggcaactaatccgtggtatttcctagtgatcggattggctattcctgtgttggaagagctaacctatcgcaaagttctattcggtaatcttgtgaatgtcaccggtatctttggcggtgccttgatcactagtctcctgtttgctttaacgcaaccgggtggacactggttaagcgccacattggttggacttgttcttgcatatgattatcgacacactggcgcagtcagcacggctattatcgcccgccttggatctttgtgggtggtttggctttactatctcgcccacaccctataatcgtaatcgaatattaaccttgacccctgctttcatcccttataatagaaataatgattttgtgaaggagcagttcaaacatggagacccgttctaatcgccgccaacaacaacagaagccgaggcgttttcgctggggcaaattgatcggcctaatcgttgtggttggtctgttcacaacaggtgcgtatgccttgcggttatacagtcaggcaaaatatgccatcaataatacatatcatgcgaccaaacatgtcagtaccgacattgctaacaagaagccgttcgccgttttgctactaggcgtcgatactggtgctgatggtcggattgaaaaaggcaactctgataccatgattgttgctgtcgttaatcctaaaaccaagaaaacaaccatggtcagtatcccgcgtgacaccgctgcagagttaattggcacaaaggaattcaacatgcagaagatcaatgccgcgtacaacgttggcggttcggacatggcgatcaacactgtttccaagctggtcaatgtcccgatttcttactacctaacaatcaacatgggggcgcttgaaaaagtcgtcaatgctgtcggcggtattgatgtcgtcgtaccgttttcctttcaggatccatacactggcaaccagaagttcacgaaaggccccatgcatctcaatggcaatatggcgttggcatattcacggatgcgtcactctgacccagagggcgattatggccgacagaagcggcagcaacaagtcatcaaggccattctcaaaaaagcaatttctgttggatcacttggcaattttaccaagctcatggacactatctcaaaaaatattgccacgaatatgagttttgatgatatgcaaagtattttcttgaattaccgtgacgccgccaaaacagtttcgactgatcatttgcaaggtgtcaacgcatgggtcggtgatggtgcttaccagattgcttccgacgctgagatgcaacgaatctccaacaaacttcggacagctctggggctgcaaaccgaaaccatcagcaatgaagagacaaaacaaaatgcgaagaacacgcagtttgactttaaggcaaccacggaccaaaactacattatctttaccccgtatgattgatcattcaaaaacacccgcagatttcactgtctgcgggtgtttttgcgcttaaattcaagcctcaagcaagtttcttctggggtcgttcccgataccaccaccagaaaccaagagcaagaatggctatgattgaaacggtataagaaagcagctcattgtttaacagccactgaccaagcccgtatggtatgacagccaatgcatatatcatgaccacccagcgcaattttggcagtaagagaacattgcccgcattttccagcgaaatgtggtcaaataaccatctcgtcgcaaaatagccgataatactgataaccatcgcggcaataaagtaggcaaaaaataagttgttgcctgataaccggactggattcgaccgcatcgttgaatagatcagtcgatctgctgcagttgccccaaaccacgtaccgaacagcccgaagacccccatccaaaacggtgacgcgaaaatcgtaccaatggcggtgccgattgtatacatgaaacttacaaccgctatattcatgagcaaaacacctaaaagattcatcccactcaatccgacatacatagcaggaatggcaacataataacctaggatggtgatccctgagccaagcatcatcgcaccaagaagaatcagaaagccataccaataacgtgttgcaaatacccttcttcggcgaaacccactactgaaaatggctgcattaaaaccactcgcttggtcaatactggctattgctaaaccgactattagcggaatcaaatacgagacaaccgtgaaaaagcgaccactaataaggtcagacaaaagttgccctttttgatttggaataaaaagatgacgctggtcttcccgatactcttcataacttttattgttataaaaagtaaggtgatttttcttagcctcttgtttactttcttcaaactgcgctaagtccatgacgtatttttgctcgttatggtagttttgtatgctttgacccaaattcaccgctgacaacaacaggacaaagactaccatcacccgcaacaaaactttatgtcgcgatcttaccagtttcaataaacgatcttcacccatttatttcacctccgcgtttttggcgcgaaactcaactttaaataaatcagatagcgataacggcaagctctcattcagcacgggttcttctgcagcaatcgcggccttgacttcaggtgtgaaatgcgggaaaaccgcttcgatcacgcgtccacgaatggtcagaatccgaccttgttccctgatcacatcaggaatcgccttggttttgaaaactaactgcagcttgatcgcctgctgtctgacatcctctagcgtcaagtcctgactgatccgaccggctttaacgaacaaaacgcgatctgacaagccatccaattcgactagattatgtgaggcgatgagaaaggttcgtttaccatcagcaacagcatctaccaccaaattgacaatccgctcgcgaatcagcaaatccaacccatcaaatggttcatccagaaaaacatacggtgccccgctcgccagcgccaacgccaccatcaccaatgcctgataaccttttgaaagactctgaaaacgttgtgatccttgcaggccgaacttttcgattagcgccataaaccgcgcttgatcaaacgtcgcatagagcaattgataatcgccagcgattttatccagccggtatttacggaagaagagatgttgattatcaaggtaaaaaagattttcgcgttgttcgggatggtcggtcaagtcctgttcatccaactcaatggtgccccgtccgcacgatattgatgcgtcactgttcggaagatggtcgttttcccaataccgttaggcccgacaagcccgaccacctgccctagtgataaggaaaatgtgatgttattcagtacagcctgatcggcaatctttttttgcaattttgtgatcgttaaactcatgcttgtccctccttctcattgagccatgcctgcagaatgggaatgctgatccccaaactctgcgcttcaaccactaaggcatcaaatttaggccgaaatgccgcaatatcttttgtattggcctgccttaacggttcggcaatgaacgagccgcgtcctggctcaacatagatcacgccatctgcttcaagctgcttataggcctttgcaatcgtgttgggattgagctgctcttgttttgccatctctcgcaccgatggcaatttgtcacctggcagcaacacgccttgcaccacttgtgctttaatttgcaacacaaggcgctcgtagtaagccaaatgggcatacggatcagtcgccatgaccacgccccctttcgtattatgtgtactattatacgtagtacacttaaaaaggcaagcgaaaagagcaagccttatcgaacgacttgctctcacgttttttccaaacaaaaaacgccgactagcggcgttttcgacaaattatgcttctggttcttttaaagtcggcccgtaatgttccaagaaataaatgagcgtctgtaattctgttgctaggtcaacgttttgcacgcgaacataacttggtacagagatgcgaatcggggtgaaattcatgatgcccttgatccctgctttaaccaaatcatccgtaatgtgttgcgcagcatcaatcggcaccgtcaaaatcacaatttcgatttgctgatccttgatctgtttgatcatttcatccatgggatagattgggacaccgctttggatggtaccagctaattcgggattaatatcaaagccagcactaatccgaatgttgtttgcctgccgaaagttgtaattcaacagcgcgtgaccaagattgccgacaccgactaacccgacattggttaaccgatcctgattcagaatctttttaaagaaattaagtagatcgacgacatcatagccgtaaccgcgtttacccaatgcaccaaagtatgaaaaatcacgccgaatagttgccgaatcaaccttcactgcgtccgacaattcagtcgaactgatcttggttgttccggaattggctagaaaattcagataacggtagtacacgggcaggcgttttgccgttgctttggggatgattgtttccgccatataagcaagcctcctgtagaagtattcccacgcagaacatgtgaactgtccaacatagtatctcttgcttatattagctggtttatagtgtgaaggcaagcggatacatcttcacaagcaaattttttattatccagggaccatcggggaacgcgcgccgatgaacgaaactatggtatattaggttctaacgattattgtgaaagaaggtatccctgtgatcattttgcaggcgcaacaagttggccgcagttttaacggcaatgaattatttgctaacgtcaacttagaaattcaaaacggcgcgcgcattggcttagtcgggcccaacggcattggcaagacgaccctgctggagatcctgactggtattgccccacccgatgctggtcaggtcacaaccatgaagaacctgtcaattggttatttagcacagaattcaggacttgattctgacaaaacgatttttaaagaaatgctgacggtctttgcaccattacaagcgatggctcggcaaatacatgacttagaagttaaactcggtgatccgcaactcatcgccgacaaagaagcttttgcggcaacgatgaaacaatacgatcaattgcaacatgactttaacgtacaaaatggttatggctatgaagccgaaattcgttccgttttacatggttttcagttcggcgaaacgacttatgacaagccggttggcactttatctggcggtgagcggtctcgattggcgctggcgaagctgctactcgaaaaacacgacttgatcatccttgacgaacccaccaaccatcttgacattgaaaccttgagttggcttgaagggtacttaaaaacctatccgggcgctattttaactgtcagtcatgaccaatatttcctcgatcacgtggtcactgagatctatgaattagatcatcaccacgcgacacattacaaaactaactatagcggctatctcaagcaaaaagctgatcgtcaagctcaagcttggaaggcttacaataagcagcaggaagaaattgccaaactgcaggattttatcgacaagaatattgtccgcgctagcaccaccaaacaggctcaagctcgacgtaaacaattagaaaaaatggatgtgcttgaaaaacctgctggcgataataagacggtgcattttaactttaccccaacgcgaccaagcggtaatgaagttttaaaagtcgagcaggcgacagttggttatgagccggacaaacccatggctggcccgattgactttcaagtgaataagtttgaccgaattgcgatcatcggaccaaatggtgtcggtaaatctactttactgaaaagtgttttgggaaaaattccttttcttaaaggagatgccaagtttggtgccaatgtcgacgtaggctattacgatcaggaaattcaacagcttaaccctaaaaatactgtcattgacgaaatctgggacgatcacccgatgatgcctgagaaggatgtccggtccgtgctcgcggccttcctttttttggcggacgacattcaaaaaccggtcagtgccttatctggcggccaaaaagcgcggctggaactcactaaattagcgttgaaacacgataatttcttagtgcttgatgaaccgaccaaccatttggacatcaacagcaaagaagtcctagaacaggccttaaaagacttcagcgggactgtcttatttgtttcgcatgaccggtacttcatcaacgagttggcaacaaatgtggtcgctattgccccgaccggcagcactacttatctgggcaactgggattactatcaagaaaaactcaccgaaactcaggcagaagcagccgccgcagccgctgctcagccaacggcaaaaactgaaactgctggtgcgacctcttaccagcagtccaaagaagacgcccgcgctgaacgcaaacttcagcgggaagtggatgatttagagcagcaacttcaagatcttagccaacaagaggccaaaattcaaaaagcgatgactgcaccagacgtcctcagtgattatatcaaaatgcaaacattgcagacagaactcgaaacagttcaaaaacaaacagctaaagttgaagacgcttgggaagaaaagggcattcaactggaagatatgcatgctgataacaattaaaactgctgttctttaaattcaaaataggcacggccaaagatggtccttggtcgtgccaaactccgcaatctccggccagatggggtggcgacgcgtagctagagctgtgacggcgcttcgagcccatctggcctacgattgctccttggcactggtatctttgagccttaaaaaatatctccgagaaaataataggcgaatgattttccttttacggaaaaatcattcgtctattgttaactgtcaatgatgttccaacaccatttttgttgtctacttactcgaagccttctcatcaatcaacgccaaggcttgccgcaaaaccttttcaccgtccatcatcccataggctcgcatgtcgataacggccataggaatattagtaccagcaactttagcggcaaactgactttccataaagcgtacttgcggtccgagcatcaggacagatacgggttcagatgcaagtttattatcagcatctgctgctgccgttgcgaaaacatcaacatcaaggccatctgcctctgctgcttttttcatccgttgtaccagcattgaggttgacataccggcggaacagaccaacataatcgttttttcagccatgggaatcatcctttcgttaacaagcttatctataagataagtctaaccaaaacagttaggcggcgtcaacgaaatcgctgtcggccttgcatttattatgaagcgtgggtaaagctcaatcctggatcagcattcaagctttctgaagcaagatgctgcttcgcccattcaatatgagcagctgcgccaatcattgcgccattatcacccgtcaagcgaagtggcggcacaatcacatcgacatctggaaaattcacagccaaggtttcgttcatggcttctttaagcccttgattggctgcaacaccaccggccacaatgagttgtttaaccggatactgatgcagtgccttttgcgttttgtgaaccaaaacatcgacaaccgccgcttgaaaactcgcggctagatcttctcgactgagctcttggcctaactgatgggcgtgatgaaccgtgttgataacagccgatttcaaaccactgaagctaaagtcaagattgtcttctttatccatcgcccgtggaaaatggaaagtgtcttgaccaagatgtgccaaccgatcaacttctttaccggccggatatggaatgcccagaatccgaccaactttatcgtaagcctcaccggcggcatcatcacgtgtatcgccgatgatttcgaattccccagctgatcgcatataaaccaactcagtatgaccgcctgaaaccgccagtgccagtaatggatacgcaagcggcttcacaaaacgggcggcataaatgtggcctgccatgtgattaaccggaattaatggtaaatgatgagcgtaggcaatggttttggcagccgtcaccccaattaacaatgcgcctactagccctgggccgtatgtgactgccaccgcagtcaaatcatcataagtgacgcccgcttctttcaacgctgcatctgtaaccaacgtaatttgttccacatgatgacgactggctacctccggaacaacaccgccaaatcgttgatgacttttaatttgtgtggcgatgatgttcgataagattgtgtcaccattttcaacgacagccacactggtttcgtcgcagctgctttcaaacgctaaaattaattcccttgctgccacattgttctcctctacaacgacgataatgatcgattacggcaatggccgatacatatcgagtgcatcatcgtgattgctgacataataaccttttttaattttcccgtcctgaaaaccgagcgaccgatacagatgcttagcaatgtcgttattcgtccgcacttcaagcgtcattttttgactgccataatcaatcgcccggccaatcatgaactgcatcaaaaaacgtcccagacccatgtgctggtatgctgggtccaccgcgatgttggtcacatgggcctcacttaaggtaaaccaggtgccaattaatgcgactaactgaccggcatcttcaacagccaaatacaacgaatgccgaactttacgcaactcagagaaaaaagcgtaacgatcccacggtgtatcatgataaatccgtcgctcaatcgctaatgctgcatcgacatcgtcttctgtcatacgccgcagtaaatactctttattgcgaaccgtgatcgtttgtggcttaaagctcagttcatcaggtgtcgtgcgatcgaaccacgatttaaactttctcaacataaacatcatgtcctctgccggggtgtgcttccaaccagttgtgttccgcctcggtcagccgcagataacgcggcacaaaatcataaacagacacaggcggcagatcttttcctaattgtcccaaacgtaatgcttgtggcaagttcagccaactcggtgcaaattgcgctaatccgcccaaggtttcaataatctgagcccgaaacatagccgcatcactgccgacaaagatcaccggctggtgcaaagtggctaattcagtgagcagtagttttaatggcacgtgccgatctgtaaccacattgatcagccggcccttgttccattggtagacacctgtaaacacattgttgcggcgcgcattcataattggcacaatcatcgcttttgtatctgtgatgttggcggcaagcaccgccaaactggaaacgccagctagggcaatgttcaatgtgtaagctaatgttttccctgtcgtcacggcaattcgaatgccagtataggatcccggtccatctgcgacaataatcttatccaagtcctccggctgcaggccactagcagccactaaatcatcaatcgctggcagtagttgctcactatgcgtccgttttcgattaatcgtcgtctgcgccaacaacttatcattatctaacacagcaactgacatcgcttcgtttgaagtatcaagcgctaataatcgcatcaatagaccctcccttctcatggcataatcatggcaatattctatcacaaataagagcagagcgtgagctggcgcgtttagaaaccggaacataagcggcctaaagcctaaatggtcgggtttggaccatttaggctttaggtccttatgtgcaggttgctgcgccagcgaacgcgtttcagtcaagagcgtgagccagaccgctcagaaaccggagtgtaagtgggcctgaacgtgatggccgcgctttggccattgcgttcagggtccttacacgcaggttgctggtctggcgaacgcgtttcaatcaagagcgtgagctggcgcgtttagaaacctccgagctgaacgataactgtttttccttcactccctgagttacttacacacaagcctctgagcctctggtaccaattctattctctattctacgctttggggtttccattactccgagttggctccgcggcgattcagggtggcgaccgcgaagctagagtggtgggcacagctttgaacccgcaaaatgcgcggtttcaaagtctggccttggtctaagcggagaaaaccactccgcttagaccaatgtcaccactgagcccatcgccgctccgccaactctctgttttctaccggaaagcaaaaaccagaaagaccattatcatttatgattcaattatttaaacctacattattcgggaattcccgtacaaacagcttcaaacctttttatgctcaaatcctaaaaccaagcctctcccggattcggtagcatgcctgtcattgctgcaatgagcaggagcacactgccaacaacgagtaaaccttgcagtgcgatttttaaccataaccgttgatgaatgatctcatctggtgtccagtagagatcggtggcgctttgaacaccggttgttttatttgccgccagcaaggcatcatggagccacttggctagccatgaccaagcaacacctgcaatcatggtagccacggccagcacccatagtgcatgatcacgttcagttaaatagtcagtcggaaagacgtagaagttgccgatgatgggtaattgaccaaattcgctataaaactgattgccaatggcatatgcaagcgccaagccaccaacaatactgcctatcagtcccaatcgccgaacccattttgcaattgtattctcacgatacaaattacgaatgtaagtcttgcgtccgctgcgcacctggttcggaaacatcatcttgtgtgttgctaattgcatcgtcacgattcgccgttccagttgcagtgcccaaattcctgtccctaccaacgccaacacaaccacaatgattaatccagcaaacatagcagccaacccttctgttttttttttgagttttcttattctatcagttaggtttcatgttgaccactttggggcacatactcgatatggcagattgccaacaattaaaaaccccagacaagccgaccatcgtgaaagcattcagaaggtcaatctgtctggggctatttttaatgtaaaaatacgatctatgactggcttgttcaaagcgcttgcttttatagcaaatcaatcaaaggtggggacgaattcgctcaatggcttttaacgttccataagacagtgccgtttggattggcaacatgaccacgttcttgatcgttcgcggccagataatgccttgccatggcgtacccatgatgtttaaccatagtgttgtcaaaatgatattgctaatcaacaaaaccatgccgacagcgagcaatgtccgaagaaccgttaccttcttgccgtggaaaaacatgccgtaaagcattgccgcaatggctgcactgatggtaaaacccgggaagttggctcccggactgaagatcataattgacaactgatcgttcagcgcagcagcgccggccgccaaccatgggccaaaataatatcccatgaggatcgtggcaaagaacgctgggctaatcttgagccaaggggttccgaacgagaaacggcccagaacgatttgcatcgccatcaacatggccatatacaccatgttccgggtggaaagcttgggactactaaacgataatacttgcataagctgcaatctccttttttcggagacgcctaaatatcaggcgaatgcggcacctgcaccgcgacacatgtcttcgtctgccgttcacattccgttccggcagcacttaacgcgcaggttcctactcctagattttgtcacgagacatatcgtacaccgaaaattgtggaaagggaacccccgaaatgttcgcattcgcattttttgtgatcacacgtgaaaaatatctcacgattttctcggtattttcttggtttttaccaagttagctgccagattgattcgctaaaatagattctcgtaatcatatctttctggttgctcatactccctgaaaagggattccctcaacacttcattttagaagtgtttttttacacctaattatgggtgttcgcgccattgactttagctgttcgcggctgcataaagagccgtataatgaaatgcgacaacgtttgaaaggaagatatgaccgtgactaaacatattctcgttttgcatacgggtggtaccatttcgatgactgaaaatagcgaaggtgacattatgcccagccaacataacccgttacttggtgctgacagttttgtccctgctgacgtcgaactcaccactgaagaaattttcaacctcccatccccacacatgaccccagaacggatgctagaactcgttaaacgcatccgccaagcggaaaaagaaggcagcgatggcgtcgtgatcactcacgggacggatacgctggaagaaaccgcctattttcttgatctgacccttgattcggcgatgccagtggtcgtgacaggcgctatgcgctctagtaacgaaatcggcagcgatggtctggagaatcttcaaagcgccattaaaacggctgccagcgacgactcacgcaataagggaacgctcgttgtcatgaatgacgaaattcataccgctcggttcgtgaccaagacgcacacgaccaacgtggctactttccgaacaccaacattcggtccagtcggtttggtcaccaaagatggcgtccgattctttcaagaactgattaatcaagaaatctgtgcgattgatcacctcgtcaacaaggtcttcctcatcaaagcatatgctggcatggatggtaccttgttcgatgcactgcctgaagatacccacggcttgacgattgaagcgctcggtgccggcaatctaccgccgaccaccttacctgccattcaacggctgctggatcgcaacatcccgattgttctcgtttcccgctgttttaatggtgttgcgcaagccgtttacaattacgaaggcggtggtgtgcaacttaagaaaatgggcatcattttctgtcaaggcttgaatggccaaaaggcacgaattaagttgcaagtcggcctcagtgacggcaaacaggggcaggatctagccgacttcgtggataatgctgttagctgacaactaacaaatagctgggactatcctcgatttcgaagaccgcaacgcaaaaacggcactaagcaaacgtctcttttttgcttagtgccgttttactatgctttaaaatcctgccagatcatctgcgcttctgcgttgacctgctcgccggttacgacgcggtgcaaggttttggtgggatcatccggatcatgctgatattgggcaacaggcgtcgtgccatacgcgacttcacgttcataccgaatatccgccccgcgtaacgtatgggtactcaaaaaatcatagccaagactattttccatccattccaagtaatgagcattgttgacgtgtccgttactgtcaatatcaaaatagcggacatgaaaatcttcttggccatctggggtggtgatctttttaagccgcggaaatcgcttgattttgcgatcactgaccgcgccgacacgctccaccagttccggaatcacgtccacaattttgcgggtgcgcagatccatgatgatccagttgctattcactgttaccaagcgctgcccttgcgcatcgtcaatccaataatcccggtaagtaaagaatttattgtaagtcgtcgcctcggtccccacgcgcaatggttcctcaattcgcggcatccgctgaatatccatatgatactgcgtgatcacccaaccagcctgaaattcattaattgcatccatcccggcatgcaacgtctctaactggcgctccgaaatttctaacatgacattcatcatatttgccaatccggcgcgaccataccgatcacccgcaaaaccgggaatccggtaatcatcttcgtagacctttcccattaggatgactcctccttaaatcacacttgctggcacagaatccggttggcttcgcataagcctgtttctaaacgcaccagatctcacgctttgcttatttttccaactcatgatatgcatcatacaccacttgcttcgctaagccattttgtttggcgactaatttaatcgctgcatttggtttggcaccagtggccacaattgcctcaacttgcatttttaaaggcaccgtcacatcaactgctggcttatcagccgcaccttctaccataatcacaaactcgccttttaggtcaccagcggcataagtttgtaatgccgacaatgaaccgcgaatgaaggtttcgaattttttcgtcaactcacgggccaaagccgcctgtcgatcaccaaaagcagtctgcattgctgccagcgttttgccaacccgatgtgggctttcataaaaaagcaaggtggctgattcatgggctaacttctccaattcgcgatttttctccccagctttacgcggtaaaaagccgtagaacaaaaacggctgcggcggcaagccggaagcaatcagcgcagttgtcgcggcgttggctcctggcaatggcaccactggcacacctgcatcaatggctgcgcgtaccaattccttgcctggatcagaaatcgacggcataccggcatcgctgacttgagcaatcgtctcgccgtttgccaacttagccaacagctcaggaatgcgcatctgtgtgttatgttcatgaaacgaaatcgttttagttttaatctcaaaatgatttagtaacatttgcgtgtgccgcgtgtcttctgctgcaatcaaatcgactgttttcagaatttcaatcgcacgaattgtcatatcgcccaagttgccaatcggcgttggcaccagataaagtgtgcctgttgtatgtgaaccgaagcttcgttgttgctccaagtcaattctccccgtaaataatctcagtacaaaaagcgcatggctcatcattgacccggcgctggccatagaacatcgggcaaacatggaagccttcattatacagactttcaagattttgcttcgacttagacaattcaaccccaccatcactagttttattgtcatctttttctaattctgccaaatgttgacgcaaatgcttgttttcgatctcaagttcagcattgcgttcaagcgtttctgccatatcgtccttcatagcggcgatttctctgagcatctgctgggcatgtttttcaagggtcaagaagccatcatataattctttcttttccacaagatcacccttctaatagtttaagcattaactgttctgttgcggattgaaacgtaacattctggctcaatcgcacctgcgccgttaagatagcctgcagcgccgtggttagttgctcacttgatcgctgagccaagacgccgatcgccggcaagtccagttgttgcattgatgttacctgaaaatgttgattcaatgcatcagcataggccaagccgatcagcgccaacacttgacgctgactatcagcatctttagcaatcggcagcagttgcgtctgcacccgaacaaaactttccggatcgtgatccgccaaacgctccagtaactggaaaaccttcgtcacccggtcttgaaatgttgcagacgccaacaaggcctgcgcatcagccacattgccagtcaatcggcctgcgactcgtgccatttgcgaggttgctccgccttcttctagctttgcaatcacggcagagcgatcagggctttggaatgtaataacctgcgcccgcgacaaaatggtcggtaaaagttgatttttcgaggttgcagtcaaaatcacggtcatcccaggcactggttcctcaaaaaatttcaataaagagtttgccgcacctgctgtcattttatcagcatcttcaacaacaaacacacgttgattgccttcgaccccggttttgctcatttcttgcttcaacccgcgaatatcgtcaaccttgatgctttgcgtttctgttttgaccaccatcacatctgggtggttatgattcaaaattcgctcgcactcaggacactggccacatggcgcaccatcctgcacattttggcaaaataggcgcaaggcgatccactcagccaaggccagcttgccagccccttttggccccacaaacaaatacgactgtgccaattgcttgcggtcaatgattcgcgcaaactgagccacgagtttaggctgaagcgaatcaattaaaaacttggtcatcagaagcgatgaaaggcttcgatcggtaggacaaagacggtggcaccgccgacttgaacctcaaccggataggccatcgaactgtcagacgtggcgtcaagattgactggcggtgtcatgaattgttggcgggtttgggaagtctctttgataatcttcagaacttcatcgacccgatcgtcagcaatcccgataatgaaggttgtattaccggctttcaaaaagccaccagtcgttgataatttagttgcctggatattagcatcaataaattgactgctaagcaagttgctatctttatcttgaacaattgcgagaattaatttcatgcgtgccctccttgaccgcgatgacggttatcatttagttaaatagttccggaaaacgacgagtaatggtctgaaaacaagcggcaacaaccttttccagtggctcagttgcatcaatcgacacgattcgctgaggattatccactatcagtgtcatgtatgcatcatgaacgcgttcatgaaaagccagactttcctgatcaagtcgatcatattgacgctcgttttgatgggacttgatacggtcaagtcccacctgaactggcacatctagatacaatgtcaaagccggctccagtcctgcagtggcaaattggttcattttcaaaacggcatctggcccaatttctcgaccaccaccttgataggcaactgaactgtcgacaaatcgatcacagacaacaatgtcgccttgtgctaacgctggttgaatcacttcaaccaagtgctgtcgacgcgacgccgcgtataaaagtgcttcagtccgcgcatccatagcagtgttggcagggtcgagaatgacctcgcgaatggtctcggaaatctttgcgccgcctggttctctggtcaaatgcaatggcacccgcacgtgctgttcgagttgcgggatcaacgtcttcaaaacgctggtcttgcctgcaccgtctggaccttcgaatgtgataaatgtgcctgtcactatatgccgctccttctctaaacgcgatctctggtgcagaaacctacacataaggaccttggtcgcaatgaccaaagtgcggccatcacgcgcaagcctgcttatgttccggtttctaaccgcaccagttcacgctctttttggaattaagtccattttacttgatatgtttcacaattaaaaacttatctgcaaattcacgagactaataagtcgttatacataggcaaaaaagcggcaaatgtcatgatcctgaaatggcagtcatgggcatttgccgctttagtgaatgttgattggtatcgggtagctgcacgatgccctaatggtgaatgagttatgcttggcattgaggtttttgcatgcctcctaggaaggcgaaaaaagatgccactcggcgtagcgaatgattggcgcgttgaacgttctcttgttggtacgtggaaaagctctgttaccccttcacgactctctgaaccgcgcaaaaaagcgcagaagcctccgtgtaaggactttgaaccaaaagagccaccgcccatcccttttggttcaaggccacttacattccggtttctaaccgcgcttttttgcgctctataaatctctatactccgcaatttgctccgcagccactcgggccacaagttcgcccttgatttggcgggtgcgcgcttcgcggtagagaaagtcgaataggcctgtctgtaaggctacttgcgctttggtttgttcgtcgacttcacgaaaagtagcaacgagcttgcgttgtgccgccatctggtcgcggacgcgatagacgagcatcattagttcttcgtctttttcttccttgacctttacctgtttgcgtccaaacattacagctcagtccttccttcaaccgccttcatcaaggtcatttcatcagcatactcaatatcactgccgaccgacagcccatgggctaagcgagtgaccttaataccagctggtttaatcagccgagccaggtattgggcggtggcttcaccttcaggcgtggcattagtggcgataatgacttctttgactgccttatttgccttaagccgttttaacaaactctcaatattcagatcttcaggaccgcggccttcgattggtgataaaacgccatgtaatacatgatacaagccatgataatcctgagcccgatcaatgctcatgacgtctttaggttgttcaacgaccaatatcgtgctttggtcgcgacttttatcgcgacaaatagcacacggatcctcatcggtaatgttgccacaaatggaacaataatgcagatcctcttttgccgcgacaagacttttagcgaacgccgtcacatcgtccttattcatatcaatggtgtaaaaagccagccgtgtcgcggtttttgccccgatacccgggaggcgcatataactgtcgatcaatttactgatcggttctggatattgcatagtgtcccctcttgttgtgaaaacgtactgagtgatgatcttgctgtcatgagaacagctttggtttcaaaatgatgcttatttgcttatgttgctgaaactttgggtggcgaacttgggttgttgtaaaagttcggtttatgcggtgaagacttcttgatgatacttgtggtccattgtggttctctgaaacgcgcaaaaaggcgcagaaacctccatgtaaggaccttgaaccaaaagggccaaagccccagcccttttggttcaaggccgcttacactccgttttctaaccgcgcctttttgcgctctgttgttacattggcaatccgcgtgtatacttgcccatcttatcttgagtttccttatcaatggttcccatggcttgattaaccgcttctataatcaggtcttggagcatgtccggatcgtctggatcgatggcttctggtttgatttgaatgtctttcatgatcttttcaccggtaaacttaacggtgaccatatcggaagctgacttgccttcaaattccgttgcatacagttccctttgtgctgcctgcatttccttttgcattttctgcatctgcttcatcatgccttgcatattacccattccacgcatgtttcatcatccttttctagtcatttttgattgttacgttaggtgcatctttaccaaatagttctgttaatttgctaacaactggcggtatctgcggtttagtgtcagctttctgttccttgttttcaggggccttcaattcttgaatataatcttgtcgaatggttggccagacatcactttgaaccaaaacaatttttggctgcttgccggttaatttttgcagaccactttccaattccgtcatcagcgcagcatcattcatggcgcgttcaacgtagatatcataatcgaaactcacgatcacaccgttaggactggcagcaaccggttcactgactttcatcatggcgcgtttcgtgatactaagcagacccagcagattcggccaaacatcctttaaattggtcaggtcctgtttggttgcggcacctaaaatcggataaatagctttacgattgacatggttggctttggccttcacatgtttccgggttctggttggtggcggaatggtgccgccgttcgcctcaacccgtttcagttgatcactcagctgtttgacttttgccgtcaatttttcaaattgcggattttctgcctgtgctggtgctgccgtaacctgttgcgttgtcgtttcgcttaatcgaaccgttgccacttctagataaatttccggatgattggtcatccgcagttgttgctgcgtgctattcaacacgtcaatcatgtggtagatctgctctggcttgaagttctcgctcagaattttgaattgatcatcaagtaagcttttttctaaatcacccaagagtgtcggtgtttgttgattaaccaacagatcccgcaagtattcaatcagatcttcgattaaccgcccagcatctttacctgacgctaacaaatcctcgatcattttcaatgcctgcgcatgatcctttgcgaggaccgcggctaaatacttgcccaaaacagcagtggtcacaccgcctgtgacatcaagtgcatcttccgttgtgacgtgattatcgccaaaactcaacacttgatcaagaatcgataaggcatcccgcatgccgccttcagcagctttggcaatcactttcaacgcagcatcgtcgtatgtgatttgcttatcatccaaaataaaacgcattcgcttaacgatatcttccggcgtgatccggcgaaaatcaaatcgttgtgttcgcgaaataatcgttgctgggattttatgtggctccgtcgtggctaaaataaacaccacatgcgccggcggttcttccagcgttttcagcagagcgttgaaggccccgctcgataacatatgcacttcatcgatgatatacactttgacgcgagcttgtgttggcgcatattttgccttgtcccgaatgtcacgaatctcatccacgccgttgttagaagcggcatcaatttcgataacatcggtcaaactgccattattaatagcctgacaaatttcacaagtattatctggctcaccatcctccaagtgtagacagttcagtgccttggccagaatcttggcgaccgatgttttaccggtgccgcgggggccggtaaaaagataggcgtggcttgtctggccagtaatcagcgcatttttcagcgtcttggtgatggcttcttggccaatcacatctttaaattgctgcgggcgccacacccgatataacgcttgataactcaccgtgccgcctcctttaaacacgtttgctgacgccgtcacctgctcataagggcctcaggtgcaatggccaaaaaccagccatcacccctgagcccgcttatgctccggtgactaaacgcgcccgttcacgctcttcttagtgaaatattcgctgtgttctagtttaccatagctgcctcatgagtagacagaatctgcgacaacaaaaacggccgctccaattacaagcgaccggtcaatttctcaataacaaaaggcacatgacgaacctaccttagtgctgcttccttccggacctgacacgattcggaaagccaccattgccttaaggcctttcggcagttttcattataactgattctcactggtttgaccagcccgcttggcggcttttcttttggcccggatcgttcggaaaaacgtttgtagcaacgtggcgctttcatcggctttgatgccgctgaccacagcaacttgatgattaaagcgggtgtccgccaataaattataaaaagtgccagcaacgcctgctttaggatcagtggcaccaaagtaacacgtcgccacgcgtgcattgatcatagcgccggcacacattggacatggttctaacgtgacaaataagctgcaatcttccagccgccatgtaccaagcgttttgcatgcggcctgaatcgccagcatctcggcatgatgcgtcgcgtcttgagttgtttcacgcaaattataaccacggcctataatctcgccttgatggacgatcactgcgccaatcggcacttcgccgattgcagcagcttttttggcctcggttagagccgcatccataaattgattgatgtcgtgttcgtccatgattgccaagcactccttgttttatcattctgatgccaataaatagccgtccatcaggaaaatcctcatggacggctattttgatcacgcagccagtttatttacctgacgtgtgatagccacatgtcgctaaactaacggctagtgactcagtgctgcctttaagcgatcaatggctgccatgccttggtcgcgagccgatccggcatattcgctagcactgtcttttagactgcgcagcttatcgctaacccggagcagactggcaacatcatcatcgctcaatttatctaaaacggtttgaacccgatcactgtcgccaaaaatcttcttcacgaagccttcaacctgacgccgctggtgctgccgttcaaaatattcagtcaaacttttggcacacacaaatgcccctgctgcgattgcggcagcggccactgcaccacctaatgcgagatatttcgattttgtcatgtcatattgctcctttctgtcctgacctgagtgtaccacgcctagtataaaaacacttattttgtcgctttaagaatatagtacccgtgttccttttttacaatgctggcatctggataaattgttttcatcagtttcaatgcagatggcgcaccttgtttcttttgaatcaccgcatataactcaccatgcggcaacaaatgctcggcagcgccggcaagaataccggaaacgatggttttaccagcacgaatcggcggattcgtcacaatcacgccaaattggccatctatctgatcatacatggaactttcgacaatcgtgacattgctgatagcgttatccgttgcattgcgctgtgccagggcaagtgcacgttcattcacatcactcatcgttacttggcgatcaggaaagtgcttcgccaaagcaagcccaatcggcccgtaacctgttccaacatcaagtatcggtcccgctggcaattcttctgccagtatggttgcgatcaaaacccgactgccaaaatccaccgtgtgtttcgaaaacacgccattatcgctggtaaagcggagcgaatgcccacctagctcaaagtcaaagctgtgctcatcatgggccaaatcaggatcattcgtataatagtgattcaatattggtgcctccttgttttgcgcagcgctaaaaattatctgctagccctcagccatgaaaaaggactgtcaaagaccatactctaataacacctaacatccggttatttgtcaatgccttgaccgagtcggctcacccaggctaaccgctttggccaccacttgttcggcgttgcaaaagtgaccttctgattcacgaccatcatgatctgcagcaacgtgaatagcaatgacgtccgtttacgataagcaacgtacttcggtacccactcagtcacatatttatttttatacgagcgcaatccttggaatccataaaaccgataaccgtattcatacacaaggtgagcaatcttttcttcaataaaagaataactagacgtaccgacattcgccagcggggccatccccatattgaaatacttaaagccgcgatccttggccaattcaaacagatgaataaacacttcatccataataccagaaggcgcatcggcactagaacgcatcaaatcaatgctagtgacctcattattacccgtcggcatgtcggtcgcaaacgccacaatcttgccatccggcgctcgcacaaccgcaatcggcgcctgattcagataatggcgatcaaagaaccccaagctgaaacctttctcactgcgcccgtccaaccatgaatcagacacggtttgaaggtcgtctagcaaagcatcatcaaacggcggcttgagcagctcgacactgtagccttcacgctcaaacttgtgcatgagcgcccgctcaccttttcgcttcgtgccagccaatgtaaaggttgtcacatccacataaccttcttcaccaaacttcatgaagtcaaagccaaattcatgcaatttcatcgtaaggctttcattaatctcataaaagactaacgacatgtcctgatcatctgcctgcttcataaagtcagcaatcgcggctggaatttgggtctcatctcccaccggttcacccatgacaatgagtttatcggccttctttttaaacaagaagaacacgcgatcttcaccgtccacttgataaaaatgcagcgatttatcacgcatcagtcccagatggctcacttcattcccgccaaatttagccacaaccgccttcaaacgcgcctcatcgtaaggatcggccagcgattttgtcggcgcggacaaatatcggaagatgagatacaccgtcagcgcggccagcatgaccccgatcaaggtagtgaagaacatccgctcagacgggaaaaggaaaacatctggcacatgccggtgatgaatggcaggcgcattatagaacacagcaaatgcataaaagataaatgtcaagccaaagacggcaccatcaatcagcttgttgccccacgacagcgccaaccggtctctggtcaattcacgacgcgtcaagataagcgcaatgacgaccaaaataaggaacacgataaagcgcagatgattatcctcgcgcaatgacgccaccatcgccacaatcaacacaatcacagtcggccagtaagcgcgcttcacgcggctggcaatgccacggccaaagccaagaattaagaaagccacaatgacatttgtgacccgatcaaggaataggaaggtgtagggataaaggcgctgatacaaggtgttttgaaaagcaagatcaggcgcaacaccgcgcaagagcaacataatcccagaaaaatacaggaaaaccactagaaagccgaatgctgctttgcgaatcaactgcactggtaagccttcaaggtaagcattcaatcgcttgccagcatcttgcgcaaacaaaccggcaccaatcaggaacggaatgacatagtagaaaagccgatagaaaagcaaccaaacaacggcggcactgctgtccagacccaactggccgagttcaacaatcattaacacatcaaaagaacccaagccgccgggcaccattgaaataaccccgatgacattcgccaccatgaacaacggcaagacagacgatagcggaatgggcgcctcaagaaaataaccaatcaaaagaaagaaagcagcacaaccgccccattcaagaaatgatcccagcgtcaggcgcaactggcgtttgagtggcatatcggcaaaaaattcactatcacgcacatgggagatgatcatgagcaatgggaaataagccgcaccgcccacgagccagacccaatagttagcaaactccgccccaataccaaaaacaaaaatgacgacaatcccgatcatggaccaaagcgacaacccagccaacaaaaacatcgcgatttttgaaatcgcaaatagcacctgcttttgagacgctttttcatggtaaaagtttgcccgcaaactagcacccagtaacccaccaaagccggcaatattggtgaaggtgttgacaatccagcctgatttaatgacataagccggtttgtagtgccctggtaacaattcagtaatcacaaaatcataagttagcatcggtgtaacggcgatcagccccacaactaacaaaatcaagagcgaaacagggctttgcgtggcgaggctcgcccgcatttgttccccattcaagtcttggctgatccggccaacctcaaaaatcacaaacactaggactgctagcacaaacagtactttaagtgtggtgagatgtttctttaaaaacgatccggtttctcggaatagttttttcattgctgcgtcctccgtgtctatattcctattcattataggaaatctacaagcccctcgcaccctttctgacctttttgtaaggtgatgtaagtttgcgagatgattgaaaaaattttttaacttttttagttgaaaacgcttgacctgaaacgcgttacagaaattacactcagtctagagtcaagagcgtgaacaggagcgcttagaaaccggagtgtaagtggcctcaagcctaaatggctgggtcttgtccatttaggcttgaggttcttatgtgcaggtttctgcaactgtgaacgcgtttccgcccaagcgtgatccgacgcgcttagaaaccacatttaggcaatgatctcaatcaagtcaacagttattttcaatcaactcataggaggtaaacatcatgttaatgcaaacacatctttatcaggaacttcctgtttatcaggatacgcaaattggcgccttgaaggccatcgctctaaagttgaccaatgatttcaattttgattatcaagaggttctaagttccttgttagccagcgcgggtgagcaaacgcaaaccatcaacgatcaggcaatcttaacttatggtcatgtcaccagtttgacagaacctgttgttattggctttgattttggcaaggctttaccttgggccgctggtcaccaaatcagtcaggcgattgtcttgttagtccctgtcgacacagctgaggcaaccattcaggatcggcttcaaacaatctccgcggcaattgcacaagatcaagatttgaaaacaatgacccaaacggcaacagctgcaatcgcttagtcatgctcacaatgagctactgcattaagatcaacgtttatgtcacaaaagtcggcatatcagggtctaaaacaaaatgaccactgacatgtcggctttttgtacgcttggctttaactgcttgttatactggaattggaggtgcttttatggcgaatattcatgacattgctcgactatccggtttctcaacggcaacggtttcgcgcgtcatcaatcagcaacattatgtagcgccttcaacccgcgcagcgattcaagcagtgatcgatcaacttgattacgtaccaagcacaatggcacaaaaccttagcgcaggcaaaacgcggacaatcggggtcatcttgccgcacaccgatcatccctattttgaacagcttgtgaccggcattttgaatgcagcaatggccggcaattatcatgcggtgatcctgccatctcgctatgatcagtcactcgaacaagactatttagaagacttacgccgtcatgcatatgatggcttgatcttcacgtctcatggtcttggcctgcgcacaattgctaagtatcaaaaatatggtcctattgtagtttgcgaaaatccgggaaaaatcaaactcgccgccgcttacgccgaccgaacacctgcttatcaagaggcattccagtggatgggtaaccaaggctacagcaaaatcgccttgctgctaagtcggccctatgcccaaagtgcgactagtaaacttaccattaacagctatgtggatgtgttcggtaaacgtcctgctgacgaaatgattgtctatcacatgcgaaccttcgaagatggctatcaagctggtgcgcggttagtcaatgagcatccagactttatcctcggcaatggggacgatatcacggccggtcttcgccagtacttcgtcgaccatcacctgcccatccctcctttaatgggtcaagagaatcagctctccagtcgattactgcaaatgagtacgatcgatcatcatgttacagccatcggtgcagcagcgttaaaactggccttgcgcgatgacattgctcagacggtgattcaatccgatttgattttacggtaagtatatgacaataaaaagcagcaacctgccatggcttcaaagccatgataggttgctgcttttctttttgtcgatacgctgctgccctaaacgcaacgcatgaacaggctattcttcacgttgtttccgtttcaatcctaatacccccatcagactgaccacaatgacacccaagaagccaaacgctggccgctcagttgtctctgctgtcttgggtaatgcccccttaccggatgtatgttgaccattacgatcagtcgtatcatccgtgctcgttgacgtcgttgtggctggctttgttgggatattaccgccagaactaggctggctgccctcatcgcctttgtccttacctgtgtcgcctggagcgggcgccggggtaccttgaccgccgcctttgtcgctagtaccggttgtatcgtcgcctttaccagctgtcttggccgcttcaacggcagctgccaccttcgttttcagactttgcaaagcttgtaaatgtgcaagcttgtcaggagcatcagcactggcttgaccagacgtcaatgtgtcagcaatgtcggcataccaagttttgccagttgcagcatctttagcattgccaacctcagccggtgttgccgctttaataccctccgcaagttttgctaatactgcatcaagtaccttggcaagactcgcttgaagctggtcggccgtttgcgtgcctgcttgagcttgtgccactagatcgtctaacgctgccataaatgttttgccagtgcttggatcagtttgattgcccaagtccgttcccagcgcagccttcacagattgcaactggttaagcagcgaagtcttcttatctgcaggtaatttggcagctaattgattgatcgcagtttgcaggtctcgattggcaccagtaagtgaatcaactgaggcgtccgtctgatcaagcgccgtttgtgccttctgcgttgctgctgctaaagcagtcgttgtggcatcatcatacttaccgctggcacttagcgttttggcggaagcaatcagattagtcagtgcctgcttagctgcctgcaattgtgcaggatcatcagtcttgatattggtcacaacatagtcgacggctggtgattcattaccgtataaatcagtcgacttaaacttgaaggtgccatttgccgtgaccgtgacaccggctgccggcacatcctgatatgtcttgccaccatcagcactatactgaaccgtttcacccattgcggcagcgtttgccgtcagagtcaccgttttggctggttcagtggtacttggcgtcacagttggtgctgccagtgttttctttggttcgtagtaaactgtgatcttcttggtcgtggtgttgttttcgctatctgtaacagcaacagtcagcacgtttttgccttcgagcaatttaacgggctgatcaatagccatatgacccggtttgccgctattgatgttgatgtctgcgtattggctggcgacatgactgccgttaattgccagactcagatattgtgcattgtcagtggccgttccggtaatctggaagttcggatcgttggtataaaccggtgcatctgtcgagctgtccaatgacaatgttggcgccactgcatccaaaatgaaggtcaacgcttcttggaaggtcttgttttgagtggtgtcacccacaacaaccccaaacgatttttgtccaagagtacctaaatctaaagtgaaactgaaagtcagatcatccttgattggaatttgcttaccatcaacctgcaacgttgtcgttgggtgcttgaccttaccagtaatcgtcgcaatcccggtcttagggtcatagaacttagccgaggtggcattgaattcattggcaccaaatgtcacaccttgatcgaacgtcacagcattcttcaacacatcaggatcataagacgaggtaatcgtcttttgctccgttgtgatgttgccgtcttcgtcggtggcggtcaccttgatggtattgtcaccataattaaccggtacatcaacactaaagtgatgttgtgcatcaagtgctgctacggtgtcgccaacattaactgtcttggtgtcagcactaaccgtccctgtaaccttgatggtcgcttcggaggtctgatccgagccattgttgaatttcaaatcagtaaaggttggcgccgtcagccgaactttggtgtcaaaatgtttaagcaactgggtgtgcgccttatcggcatatagatccacttgcgcggcgtaatcagcattcgtgaccgccattgaggcagtgaaactgttagtcgcagcatcgtaggttgtgttcaaatcatgtttctttccttgtgcatcagtgtaagtaccgtcaaccgctgctggatacgttccactaaacgtatacgtcccgccaccttgagtattggcttcgtagccagttgtggtgcttgagatcttgtctgggataccgccgccgttcacaattaaatcaaacgatgtagaccccggcttctgaacgctggcatcttgatcagtggcattggatgcattatcagtcaagtacagctcagccgaattgtcgccattgccaagtgcttgggcctgttcatcagataatggcgtttcaattttggtgtacccatcagccgttgtcccagcatcggtaaaggtagcatcaagattcgtcacttcattaattgcagttttaacgctcttggtggcatcaagaccactcaaatcatccttggcttcagctgtcaaataatactgggttttcccattttccgttttggctgacaaagcgacatgacgaactgtcggcgccttagagtcgagcttgaaaggcacatcaaacacttgacgtttgtcgccgccttccggtacaccggaaatacgataagtataactgccatcatcagccgtcttgatgttgccatcacgttgatcataataggtgccatcccacgctggagcattgtagtagatgtacttctgcgaatgagcatcataataggtcttcgtctgattggtggaactgctgagagtcgtaactttattgccctgaccatcaagaatatcaacttggacgttgctgatattgcgcaatagataatactgcatgctgatgtcattatataaggcattcttgtcactcgaaaaagcaatcgcctgatcgtcaactgtctggttgccatcagcgtctgtgaccatgccgccataatattgattgcctgtatttttgttcgtcaatagtggcacggtgccataattaccaccagcaggactataagtgatcccattgagactatcgacaatcttaccgtcattccagtcaccaaaaaagcccatgtatggcaagttcaagcgcgacccatcgctacccttaaagttcagaaaaccttcaacaaattgctgttggtcaaaagacttcggcaaagatagtgtgaattcaatctgcgccgttttcccagcaggcacagttatgtcactgccggctttaatggctgctccatcaatcttcttgtcatacaaaaccccagaattagggtcagtcgctgatgtataaacggcattagtatccgtattactgtccatttgataggttagttcatgggtcgtgcggttcgtgaaggtcagtttaaaggtcttgtccgtactcgtgaagtctttcaattcaactgccgggtagccgttttcggcgacaaccgttgacggattcttttctaatgcatcaatggctgccttcacatcaacaagaccggccccttgccgccgcggcgatacgataacattgttgtagttaatatcgttgattggctgggcagtattcatctcaactgtcttaagaaaatcggtgagcgctgtccctttaagttgtttgtagtcagcataaaatgggttgtttttgttattcaatgcttgtttcaacaatgcttgtgaaccggcaataaatggcgaggccattgacgtaccagacatatttgtgtagccattgttgttttgcgttgaccagatgttgccgcctggtgcggtaatatctggtttgaaggaaagattggaaactggcccataggatgtgaagtcagacatcttgtcttcagtatatttctgatttggtaacagcgtcagggcaatcttgacaccgagactatcatccgggtgtgctgtgacccagtcaaccagcttttgaccggttacactggagagcccaaatgttgggaaggtggtggttaacgcaatagaagtcaacggtgttgctgtgccatcgttgttgacaatgatcaagccagcagcaccagcggcttgggcatatttttgtttgtcagcaaaagtaagttcaccacgtttaacgatggcaattttgcctttagcgtcagcagtatagtcggctgctgcccctttgctgaggtcgccactagcatctttgacaacataaaacttcttttggtcaaagctaccagtgaaatcgttgcttgaaagctgaatggtttccggtccaagctgtaaacctgtaccatctgtaatggtcactgcctgactgatgacatccgtgttctcagcggaagcaactgtggtcgctcctcgtgatgtccctggcgttcccaccatttcattgtcttgcaaaccgtaataatctttgttgacaccttgagttgctgaaccggatgttcctgagttcccagcagaaatgacggcggctgttcctgattcgttagcattttgcaccgcagcaatttctggatcctccaaggtttggttacctgaatcagatcctaaggacatgttgaggacatcggcaccgatttttgccgagtcttcaatggcagaaaccaaggtagctgacccggttgttgcagaagtgtcagagttggtgaaaactttcattgccagtagctgtgcttctggcgcaactccgacaacagacttggttggatcgtcacctgtcccgttagcaccgatgatcccagcaacatgcatgccgtgttgttcgtcaaccgtatcatctgtaatggtgtcgttattatcagcgtaattaaacccatatggcacttttgaagtaaaatagcggccatgcttggcggtatcagtgaatctttcaacatcagatttggttagtttgacgtctttatcatcgcttagccgcatgtctttatgtgttgggtcaatgccagtgtcaataaccgagacaactgtgccttcacctttatatttgtaattggaccatacggcttgcacattcgccatcgagttggccttagcatcagtcggataataaactttcgccaatgtgactgttttaactccggcaatttgtttcagtttagggatatcaactaccctaactttagttgaaaagccgttaacgacatagccataactttcaccggcagtttgttgggtgacttgttcaacagctgccttaacgcttgcctgagccgcgatcactttattggtttcctgctgaatctccgccgtgctggagtaatcagttcttaaagtgccgttttcagaggcaggcgctgcgctcatttgaactatgacgtcaacataaatatcttgctgctgaactttattcagcttattgtaatcaatacctttagccgccaactgtgtagcaatcgcttgattcgttgtcgctgcggttgtgtcagtggccgcttgcttagcagtcgcggccttaaccgtatttgcgagtgatgatcccttagtttgctgcgagatagccgcctttgcttggatttcgccgactggcaagacagccagcgcccctaaagcgactgtaccggctaacaagatcgatagccctttctttttcctttgcatccaataccctccacttcccaaaagtttcagaaccaaatcaaaccctacgcttgatgtagttaagattatatactctcgaagaacagattcaacgaaaattttaatcttttattaattttcctatctgtaaattagcttttagcgttattatttagccgtttacagactatagatgttttgaaagttttagcattattagaaaatgagtatttgcattgaaattctcaattgccaacgctagaataaatacacaacgtttactgtaagcatttcagaggagaccgagtcgatgaagaaaaaaatgcgccttaaagtattattggcaagtaccgcaactgctttactgctgctaagcggttgtcattcaaatcaggccgaccaaacagttgcgacctattcaggtggcaaggtgactgaaagtagcttttacaaggaactcaaacagtcaccaacgacaaagaccatgcttgctaacatgctcatttatcgtgcattgaatcatgcctatggaaaatcggttaacactaaaacagttaatgacgcctatgatagctacaaacaacaatacggcgaaaatttcgatgctttcttaagtcaaaacggtttcagtcgcagtagcttcaaggaaagcctacgaaccaactttttaagtgaagttgcactgaaaaagttaaaaaaggtttctgaaagccagctcaaggccgcttggaagacctatcagcccaaagtgactgtccagcatattctaactagcgacgaggacactgctaagcaagttatcagtgatttagcagctggcaaggattttgccacgcttgcgaaaactgattccattgatactgcgactaaagataacggcgggaagattagttttgaatcaaacaataaaacgctcgatgccacatttaaggatgctgcctacaaattaaaaaatggtgactacacgcagaccccagtcaaagtgacagacgggtatgaagttattaaaatgattaaccatcccgccaaaggcacctttactagcagtaaaaaggcgctaactgccagcgtttacgctaaatggtctcgcgattcaagcatcatgcaacgcgttatcagtcaggtattgaagaaccagaatgtgacgattaaagacaaggatcttgcggatgcgctagatagttataagaagcttgcgacaacgaattaacgcttaaccgagtaagatgaaataacagccagttcttttagaaattggacatcaacgccccgaaagtcatagcaacatgactttcggggcgttttatgtataaaaaaagcatctcgtctttcgcggtatcaccacgattgagcgagatgcttttatttgaagatggggctaggttatttgagggtaaccgttgcgccaacgccttcaagttgttccttaagcttgttagcgtcgtcttcggaaagtccttccttgataaccttaggtgcggcgtcaaccatacccttagcatccttcaagccaagaccagtgatttcacgaacagccttgataaccttaactttttcttggccagcttcggtcaattcaacgtcgtaggtatccttagcagctgcagcgtctgcaccagcagcggcgccagcagcaacaggggcagctgccttaacaccgaattcatcttcgatcgacttaactaagtcgttcagttccaaaatggaagcatctttaagttgtgcaatgatgccatctacatctaaagccatgtttgtttcctccgtttattaggtagtttgtaacgtatcattatgcagcaggttcttcgtctttggcttctgcaacggccttgacaaccaatgcaaaatcgcggacaggtgcctgcagaacagaagcaagttgcgacaacagaccttcgcgatctggcattttggacatttccataatggtatccaaagaagcaaccttgttttcgatgatgccgcccttaatcttcaaagcatcaaattggtcagcatacttggccatgatgcgagctggggcaacaggatcgtcattggagaaggcaacggctgtagggcccttgaaaacatcgtccaatgcttcataaccgttagcgtcagcggcacgacgcaggtaagtgttcttcaggacttccatcttaacaccggcctcacgcaattccttacgcagtgcggttacttgttcaaccgttaagcccagatagtcgacaacgacagcactggtagcactcttgaattgttcagaaatgcttttaacgatttcagctttttttgcgatagcttgttcactcatgtttttttcacctccattagtttggttgaagtttttaaatataaaaaaactccatgtctaccaagacatagaggtatctagtgtttccgataccacctcggcaggataattaaggcttacgccccctgagtcttaggcagagtgaatgatcacaaagagtagaataccatggtcaccgacctgtgtcaaaatgttttgcgaaaaagaaactttgcaggccggccaatcccatgcaaggtcttaaacgctcgcaaaacagggcgtggttttttagataacagacgccattgtagattgcactttgttattcgtccaaatttgttatccatttctgactaataggctccttgctatcgaattgtaagccccctctgattgaggtatattaattaggtaactattttctgaaaggaagttggcgctcttgccaagtaaacttaaaagcctcgagccatggcagcaaaatctggctgtgttatggctcggaaccttcattgccggcatgggcttcagtgaagtttcgccatttatttcattatatgttgatcaacttggcgattttaccaaggggcaactgagtatttactcagggatcacgtttggggtcaccttcatggtcgttgcgatcgtgagtccgctctggggccgactcgctgatcgccgcggtcgaaaattgatgttgctgcgttccagtttcggaatggccatcatcatcggagcgtgtggctttgtccacaatgtctacgccttaattgccttacgttttctgcaagggctggcagcaggttacattccaaacgccagtgccttgattgcaaccgaaacaccaaaggcaaaaagcggcactgcgattgggattctcacaaccggctacgtttccggtaacttgatcggtccaattctcggcggctttcttgcccagaccttttcaatccggctgactttcatcatcaccggcgttttgctgctgattgtgtttgtcttgagcctaacgatggtccatgagcattacacaccggatccacgcttgctcaacaaggaaaaacgcccgagtttattgtctcaagtcaataatccaaaagctatcatggtgctattagtctccaccgcggtgattcagctaggtaatatgtccatttatccaattatcagtctttatgtcaaagagttgatgcacaatgttggtccaattaccgttgttgcaggcgtcattgcagctttgccagggatttccaacctcatcgcggctccgcgcctaggccagcttggtgatcgcatcggctcaggcaagattctggtcagtggcttgattttcgcggttattatgtatattcctcaaggcattgtcggcagcatttgggcgctcggtttcttgcgtctcatgatcggcgtttcggatggcgcgctgtttccaacaattcaaacgcttctgtctaagttgacaccggtgagctataccggcaccgtcttcagttggaatcaaagtgcccaagcctttggttccatggctggctcgctagctggcggcttcatctcaaatatttttaattataatggtgtttttattttcacagccctctgtttagcgcttaacctagtgatggtgctcgtctttattccacacatctggtcaagccgaccaaaacaacaagcataacgcatcaaaaaaaccgacctgcgtgggcagatcggtttttttattgtctaaattaaatcactgcatccgcttagcatcaagcaatagctgccaactgatcaatggttttgggtctgggagagctaactgttgatacacagtccacgcatgaatatctgtatcatcaaattcaccattcaccactgaatagcgcgcctgaacttgaaacaatgccgtttgcaataagcgacgaatgtcagcaaactgttggccgcctaaccatgcactggttaatgctcccggttcatcttcaaaccaaaagacatatgcctgcacttgctggttttcgactaagaaacttggttgagtgtcctcagcttcagccaattgttgttcaaaggttgcatggttaaaggtcaccggattatctgcatgagcagcaacatagtttgcaaaactcatttgcactacgtcatgccactgtgccgacgtcaactgggaccgtgaccgaacatcggcctctggggtagcgacaactttccgatagtcactcattgccgtacgacgaaaggccctgaaatgcttcgcctgcaattgcgtgataactgctgattgggcagcataactgctgtactgcagccgatcatgatgatcggccaattgccgcaaatcttcaagtagttgcggcaaccacgcaacatcacccaccacatcaaaatacagcgcattggcatgaaatgaattctcccatactgctgcagcaaacgtcacagcaccgctttgcggatatcttagtaaaatcgcatgacgattagcaaaatgttgctgtgtgaatgcatccgctgatgccaagaaaggttgaagcatcgtcagtgtcaccttctgaccagtaagcgctttgccctcacgcatccttcttggagtccttcttgtcttgccatgtgccatgcagtcgggttaacgaataagcataacgactggcaccgtagacgatcgggaaaatgaatccgatccataaatgattggcaaaataatattgcggtaatggattcatatccatggccgcttcgtaagccatctcaaaagcaaaaataaacacgcccattaacaccgctgagagcacaccacgcacgaccgccagccattcataccggcgatattcctccggcgtatctgcttcaatcacatgcagtcgataatgccgcagcgtgatttcattcatcaggttaatcacgatcgtcacaattaacaaaatccatgtcccggcactaatcattttaagactattagcgtcaataaaaatagcgattatcgttgcaatcagcaacatcaattcagcggtcagcatattgcgccccatgatagcgtcataggtgcgttgtttaaatcgatctttgagtgaaatgccataataccattctgtgattttcttcataggaaccctcttctatttattaattaaacaatgttccaatcttaacacggatcgccaatgcctttttcatgaatcacgcgcctttaaaaaatttttccgtgacaataaactacgattcgtcaaggaaaaatctctgtgtctgttccagttgtcaaaatattgaaattttcattgacatcacggtttgtttttggtgaaatagtaaacaagcctagggtgtcaagacaccctaggcttcattaaaggaggagcgaaaatgtcaaaaaaaccgtccggccatacgcggctgatcgttggcatcggcgttgcatggctgtttgatgccatggatgttggcatgttaagtttcgtcattgcagccttacatagcgaatggcaattaagtacggtgcaaatgggctggattggcagtgtcagttcaattgggatggccgttggtgccattttattcgggatgatggcggaccgttttggccgtaaagcgatcttgattcttactttgctagttttttcaattggcagcggcatttctgccttcgccacaagttacggcatttttcttagtttgcgattcatcatcggtgcaggcctcggtggcgagctgccagtggcctcaaccttggtttcagaaagtgtgccagttgaaaaacgtggtcgtagtgttgtcctgttggaaagtttctgggctgccggttggctgttagcagccattatttcttacttcattatgccaatctggggctggcgcgttgccgtctttgccactggtttagccggactctatgcgttttattttcgtgaaggcatcaacgaatcgcatgtctttgaaaaagtggcgcggcccggcttgctcaaaaccctcagcaccctttggcgcccgccttatgttcgcgcaaccttgatgctgtggatcgtctggttcatggtagtcttctcttactatggcatgtttctttggctgccaagtgtcatggtactcaaaggatttagtctgattaatagttttggttacgtcttaatcatgacgcttgcgcagttgcctggctatttcgtcgctgcttggttaattgaaaaatggggacggaaaatggtgctgagtctgtttctgctaggcacagccgccagcgcattaggctttggcctagccaccggtttgccaatgctactgactgccggcatgttgctctccttcttcaatctcggagcttggggcgcgttatacgcgtattctcctgaacaatacccaactgttgtccgcagcagtggttccggtatggccgccggtatcggccgcatcggtggtgtggttggaccgttgttagtcggtcatcttttgggatcacactggtcagttggcggcatctttagcattttcaccgctgccatcctcatagcagtcctagcaattatcttcctcggccaagaaaccatgggcgtgaaacttgccgacacgcttgaatagtctcaacagacaacaaaaaagccttgtaatttgcgagaattcccgcagactgcaaggcttttttactgaagttaacgccgtaatgcgcgagtaaccgtttgttcattaacaaacgtgaataacccgagatcgccaagttcacgtccatagccggagttcttcacaccgccgaatggcaattcagcattatagttttggctttgattggcaccaaccatgccggtttcaatccgagctgcgacttctgcagcgtgattagtgtcacccgcaaagactgcgccccccaagccataaggcacatcattggccagttcaaccgcttcatcttcactgtgaaccttgtaaacgcaggcaactggtccaaacaattcggtacgataagccggattgtcctgatcaatgtcagtcaaaatagttggctggaagaaagcgcctggcaaatcaaccggggtattgccataaaccactttagcaccgtgagcaatagcttcgtcaacttgcttctgcaacttgtccttcgccttttggctggtcatcgggccaacattaactgtgggatcactcggatcgccaattttaagattctcaaagcctttcttcaaaccggccacaaaatcatcgtaatatttatctaaaacaatgaaccgtttcgaactggtgcagacttggccgcaattcattaaccgcgtcttgatagcttcaggaatcacagtatcaagatcggccccgtcaagtaccaagaaggcatccattccgccaagttccagcaacgacttcttcagatatttgccagcaagtgctgccacttgcgaacctgctcgctctgaaccagtcaggcagaccccagcaacccgcggatctttaatgaatgtttcactatccgcatggccaatcaaggcaatttggaaggcgcctttatcagcaccgccacccagtacagctttttcaaattcaagcccactagctggcacattgctcgacggtttgatgatgactgcattaccaaccataaagttcggtgcaaacacgcgcatcaattgataataagggaaattccatggttcaaccccgaaaacaatcccgcttgcaagatggttaatcacaacagcaccagcagtactattgatcggttgcggctgcaacaaagccggcgcccgatcagcatacatgtccgcaatctcagcacagagttccacttcaaaaagtgcttcttccgtgcgcttacccatttcttgcgtaataatcgctgccatttcgtcagcgttattgcggaaataggcagcaactgcatgtaatgttgctgcacgcgttgctggattgacgttccgctcctgcttgtaaaaagcgtgcccagttgccaacatctcgctaatttgcgttggtgtggtatttgagtaagttttttctaaggtattcgtgttcggatcaatggtctgataagccataattgaaaacgctcccttcatatacttacttaatcatagcttattcacgcctcatatgccaactttagcaaattaatttactggcttttaataacgtccacacagcaattggtctatatcttttgatacatcggatcaaaaaaagacccgcagcgagtgcggatcttcatgtcatgctagattcagattagaagtctgaagggttaaccttgatgccgggtgccatggtagcagtcagcgccaagctcttgatgtaaatccccttcgtgcttgctggacgagctttcaagacaatatcattcattgctttgaagttctcaagcagcttgtcagcatcgaagctcttcttaccgattggggcatggatgataccagccttgtcaacacggtaagcaacctgcccagccttgatgtccttaactgctttagcagtgtccatcgtaactgtgccagtcttagggtttggcattaagccttttggtccaaggacacggcctaaacgaccaacttgagccatcattggcggtgttgcaacggcaacgtcaaagtccaaccagccgtcttggatcttctgaactaagtcttcagccccaacgatgtcagcgcctgcgtcttcagcagccttggcttggtcgccttgtgcaaaaacgatcaccttagcagttttaccagttccgtttggcagcacaacggcgccacgaatctgctgatcagcctgctttggatcaacgttcaagcgataagcaacttcaacggtttcatcgaacttagcaaagtcgattttcttaagcaagtccaccgcttcttcaggggtgtactgcttggtcgggtcaacggccttagcagcctctaaatactttttaccttttttagccattctgggttttcctccttgcaaatgtggtcactgggagataagtttttctcccttccacctgattcgctcagctttcactgagaatccgaacagtgcgtcttagccttcgacttcgaagcccatggaacgagctgttccttcaaccatgcgcatagccgcttcaacatcggcagcgttaaggtcttgcatctttgtttcggcgatttccttgacctgatccttggttaccttagcaacctttttggtgtttggttcgccggaaccgtgttcaacaccagcagccttcttcaaaagaacagcagccggtggggtcttggtgacgaaatcgaatgaacgatcttcgtacacagtgatcacaactgggataatcatgccggcctggtcagccgtacgtgcattgaaatccttagtgaaccccataatattgataccggcttgcccaagagcagggccaaccggaggagctggggttgctttcccagcaggaatttggagtttgacaatgtttgctacttttttagccacgagacatacctccttaagtccgtgatgtggttatgatggccagaagttttggcctcccacgcgtatgctgaaaacatacttgaatagattatcattttacggggtaaaacacaagttaaactcgtaaaagcacgtgaaccagtaggactcacattccaacgataacaaacacattcttgttaataattctattttgtgcggtttgtttctgacattcagagcggccacatagcggcgaggactggcgaccgcgaagctagagctgtaggcacatttttgaactcgcgtacgttcacagccatggccgtccacgtttgaggtaacccgcttttgcccattcgaccatccccagatagactaagacaatgatgacggcgcctggccagtaagctgctgggaggatgccgaagtcgaaggctttgtggagcggggataggatcaggaagaggccgactaatagcgccatcatagtggagagaatcacgatagctgaggctggggcgcgccagaatggtactttacgggtacgcaggacatgaatgaccaatgattgtgtgcagagtccaaccacaaaccaacctgcctgaaacatgtgttctgcaggtaaactcgcggcatgtgcgccaacgcccagtccgaaccataagaacaggaaggtggtaatatcgaaaatcgagcttagtggtccaaacgtcagggcatagcgcagtagaccatcggcccgccatggtgtcggcttcgcgagcgtgtcatcatcgacattgtcccaaggaatggtcatttgtgaggtgtcataaatcaggttttgaagcaacagttggatggacagcataggcaaaaatggcaagaaaatgctggcaataagtacggaaaacgcgttcccaaagttagaggcgatcgtcattttaatgtacttcatggcattagcataaacgcgacgaccctcaacaataccgtcttccaacaccagcagactcttttcaagcaaaataatgccactgacatccttggtaatatccgccgcggtatcgacgctgataccgacatcggcttcacgcaaagcggcggtgtcattgatgccgtcacccatataccctaccgtatgcccagccccttgagttgttttgatgatgcgggctttctgcatcggactcagtttcacgaaaagatcagtggtttcaacagcttcgagcaaatcattatcggtcatggcatccacttcattgccgctgatcactgcttgctcaggaatcccgacttcttcggctacgtgttgcgtgatgatcgcattgtcacctgtcagcactttcacccgaacaccatgggcatgcagcaagctgaccgcttctttggcgtctggcttggcgggatcgagaaagcctaaaaagcctgccatgaccatatgttgctcatcatcagtcgtgtaaatgcgttgttcatggacatccgtacgataggcaaccacaatcatgcgcatgccttgcccactcatcatggcattggtttgttcaagctgacgtttgcgttcgtcagttaacggtaggatctcaccatgaagctgaacctgatcacagaccgccaacatttcttcaaaggcaccttttgtgatcatccattggtggtcgtgattggctaccaccactgtcagtcgccggcgttcaaaatcaaacggaatttcatcaattttttctaatcccgctggcaagtccacaatttcgtcgtgatgttctttcacataatcaaccacggctgtatccatgagattgtgccaaccggtttgataattagcattcatataagccaaccgcagcactgccggatcggttttgccggtggcatccacataccgcatcaccacaacccggtcctcagtgatcgtgccagttttatcggtaaaaagcgtatcaatggcgcccaaattttgaatggcatgtaatcgtttaacgattactttccgcttcgacatcgccaaggcgccttttgctaagttgctgttgacaatcattggtaacatttccggcgtgagtccaacggccactgctattgcgaagaagaaagcttgtgaccaatcctgcttcgtcacgccattgatgacaaatacgactggtacgagcacgagcatcatcccgatcaacaaccgactgatggctcgcataccgcgctcaaaactggtcggatccgttttgccgctaatctgactggccatatcaccaaagtacgtcgcatccccagtcttcaaaataactgcagtcccagaaccggaaataacgtctgtgcccataaaaactaaattaggatagtcaaagacactaatatcagcatcctgttcgtagacttcagcacgcttttccactggcatcgcttcgccggtgaacgaagactggttaataaatagatcgtgggtagccactaaataggcatcggccgggatcatatccccagtggcaagctggacgacatcccctggcacgacgtcatccatcggccgttcctgcgtctgaccatcacgcgtcaccgctgttgtgttcgcaatcaaggcagccaaggcatggctagctttttgagagcggtattcttgccaaaaatgaatcgtcaccgacagcacaatcatcagactcatcatcatcgcgccatcatagtcagctgtcgcagtcgatactgccaccaaaaagaccaacacccagacaaacggttcattaaaagccgaaagtaaaatcaaataccatgggcgcggatgttgggtcacaacagtattcgcgccgactgcttctaagcgatccgcagcttcggtactgctcaaaccatctggattggttttcaatgcttggtagactgcttgatcgctcatttgactgtagcgcgtcaatgctgccgttttttcttgggtcgaggcgccatgccccgacatcgtcttctttagcatgcttattctcctataagatacgctggcaggccaagaaaccgtcaccatgaggacaatagaaaaatgagcttgatacacccattctttccgtgatcatgtatgatgaggttgttgaacgtgctagcatatgcgcttaagtatcccccaaacgtgtaagcgtgcgggcaattaactttaacaaaaggttaccgtgaatgtaagatagttgtcaaagataaccatagtaaggaaagcctaaaaatttttaaaggggaggttcatgatgcaaaaatctgcacttgatcaagccgctgctattcgcgccggggtgctgtctccagcagaattgattgatagtactcgtgagaaaatgacggcattaaacccagcgctcaatgccattacctggacccgttttgaagcagccaagcaggacgccaatcaactggaagatcacggtcaaccgtttttcggcgtgccgttgatcctgaaaggcttgggtcaagaccttgctggcgctccagcaacttttggcagtcgcttcttcgccaaagccaagtccgaacacaccaataactttgttaaggccttgcaacgactaggcttcatcatcgttggtcaaagtaatgtaccggaatttggttttaaaaacatcacagatgcagaactttatggccccgctcgtaatccgtggaaccgcgactattcgccaggtggctcttccggtggcgcagccgcagttgtggcttcaggtatgagtccgctggcaaccggttctgatggtggcggttcgatccgcattcccgcttctttttccggcttgatcggtttgaagccaacccgtggccgcgtgccaaccggacctggtgagtggcgtggctggcaaggagcatccatcaacttcgccttgacgaaaaccatggccgatacagcggcgctacttcgtgggcttgccacaacccagctagctgctcccttcatcgcgcccccattacgcttagatcttgttggcgatgcacgaccactgaagattgcttacaccacaacatcgcctgttggcacccctgtcagtgacaccgctgtcaaagccgttgaaaccgcggcggatgcgttgcgagcagcaggacaccaagtcgttgcggctgcccctgatgttgacggtactgctttaatgaaggcgtactacatgatgaacggcggcgaaactgcggccatgtttcaggcatttgccgcccaaactggcaagcaggccaccgctgccgacatggaattgattacgtgggcgatttatcaagccggcttgcacacctctgcagccgactacagtctttcacttgatgcttgggatcgcgcagcagaagcatacagccattttcatgagagctacgacttgctgctgagtccaacaacagccaaaacagcgccccgcatcgatgccgttttacaatcgccggccatcgttgttaaaatgcaacacgccgctgagctggcaccgcaggaacagcaagatttgatttgggatctttttgaacccagtcttgaatattcgccattcacgcaacaagccaatctaaccggtgcgcccgcaatcagcttgccgaccgccatctcacctgaaggcttaccactgggcatccaattcaccgccgccaaaggccgtgaagatcagctcctgcgcatcggctactggtttgaacaacaaggcttgttgaaaatgttacctgcatcgctaaaggagaagatctaatgggctcacttgctgaatggtaccaacgcattcccacgcctgatgatttaacccgagtcgaatcactttttgctaacattcaggcgcaattcccgcaactcaagctcgaactcaagtggaatcagcccatgttcactgaccatggtacgtttattatgggctttaatccgtccaaaaagcaccttgctgtagccatcgaaccacaaaccatgacgcgtttcatcccgcaaatcgacaaagccggttacgaccatagccaaatcattctctttccatggcacaaaccactagacgagcagttgatccgcgacctcatcgcctacacgattgaccaaaagaaagatgcgactactttttggcagcgataggtgtggcatgattttttgagaacaaaaagccttgaatccgatggtatctaacgtttgctatcctcgaatcaaggctttttattttgcacctcacttgctttttacctcatccactccggctctatagttcacgtaccgcgccaatgcgaacagatagtcggacaagcgattgctgtattgtaaaatcaccggctcaagcggttgacccttagcgtccaattgatccaatgatcgctcggcgcggcgagccactgctcggccatattgcaaagcagctgccagcggatggccgccaggtagcacaaaggctgtgattttcggaaccgccgccatcattttatcgatcgccgtttccaatccctgtacgtgatctgcggtaatcgtttgatgccgcggcaccgcaacatcggccaacagctcgtacaattcgcgctgccgagcttcgaggtcctcagccaaccaatcaaagtctggcgtggctttagcctgcgaggcaacatagcctagccatgaatcaagctcgtctaaatcacctaatgcgacaatctggggagaaaactttggcacctttttcccgttaatctgtttagtggcaccatggtcaccgacttttgtgtaaagtttcaaaatgtgcgcctcctcgatcaaaacgttgcaagccctgccgtaaaatggcgagtacgatcgggtaaaaaactagattaccgatggcatgatacgtgtcaaacgataacccactcacatagtacgcccaaaagccgagaccattcaaactgccaatcaccgccatgcctaaactgacaatgaagccgtatagataccctagcaagccggcaagaccgatttgcagccaaattcggcggcgaataactggcaaaatcgttaccataacaatcacaatcaccatgcagcacgcataagcaacaatctgcggcagtgtccagagtccaaagccaagaaataaattggacacgatcaaggtgctcatggtcaaactgaagccccagcgaaagccgagcaacagcgtgacaatcattaaaatatcagtgacaggctgcacattcggaatagggactttaacaatccgcaaatccgtacataaagcggtcaatagaccaagcaaagccaccgcccgaacaggcgatggctttgttactgatggctgcggcttcatttggtgacactcaggtcaaacaccactttatcgtgattcttgaccggttgttctgtcgctcctttttgggccatcttgccattaatcgtgtagagccagtaagtctttttggcaacattttgctttttgccagcaatttcggtaataaaacctttagaagccttcactgtccagccttttttcaagccagtcatgacaaccgactttttaggctgatcaatcgttttcttggcaaaagccttgccattttgtttcaactgataagtcactacaatctggttagacttgctgctgcttttggccgcatttccagaactgctgcacccagccagcacaaacatcgcaacgaaaaagaccactaatgaacgtaaaacttttttcaaaataaactcctccacacttttttatttaattgggcaagcgccaccggcacaatcggtttgatcaacgagctcaaggtccttttgatcatgatccgcgttttgaaccgcaaagacagctgcaacagaaccatgaattgcggcacacttttgcttgtaagttttgacatcaatgggttccttaggtgcctgtttgaaaccagcacctacgtagggcaacatcgacgtcgacttaatgacatggcgatactgggaaagcaaaccagcaatttgatcggcttcttttggttggaaggtgaccgtgcaactgaccgcgttgtcagaccagtacgtctgcaaaaatgcttgcgtggcaatctgttcagcaattgacaccgttccagctgaggcaaaggcaggatcatcagcgtgggcggcgcgaattgggaattcaaccaccatcgtgcctttcgtgtaaacatctggttcaatgtgataaccgcatgcctgcagagctggtaacaacggatcgttgccttggaaccgaatgcgctgaatcagataaccagcataatggaaatgcatcccttctgaaacgccggcaagtttcgccacagtccctgaaggtttaaccgttgtatgttttcgcgacggttcgcagcccaaagcatctgagtaagcctgatcggcatcgaccacagtgtgatacaaaccatcaacggcttgtttaatttccggatcgtaaatcggtttctggaccattttgccagtttgcggatcaacgactgactcaaacccgctcacaacccgccggccaaagtcattcaggaaccagtcttgaataccagacatggaaacaccgatacgccgattcttcttgatgatatcacgcgaaacctgccagtcataatgactaaaggtcacccgcttggcgaatcgtgctgccaatgtgaaggcctgtttcagcttccatccttgctcaactgcaacaactggaaagacttcaaacagattgcaaggttctccattggccaaggaaatctcaccgcaagggttggtaccctcaacatcaggatcattttccacattttcgccatcagcaattcgaccaaaccgccgtgacagttcaagattcacaatcccgggttcgccatttttggcaatggcgtgggcaatcggcgagtaagcatcgaattgtgtattgatcgcaacactattgttcgacgcccaacgatgatgataaagctgcttttgatcctgcttcatcgtgataaaatcgtcatcgtctgctgagccgagtgacatttcagcggagcgccgaacattgccagcaacgactgttttaccgatcaaattaccaatatcagtcgcatccaccgccgtcaagtgttggccaacgcgagcattgagcaacttgttgatatccaataacatctcaatcaatggcatcggtccagaggcagtaccgccaaaaccgtgaattcgtgcaccctttggccgaatgttggtgatatctaaaaccagttttgtctgaccgcttggattagtcgcggcaaaatgatggtcgatcactttcgcgttggctaacacccaaccttctcgcgtatctggcaaggcacaatgatcagcctgttcaccggcatgtgctttttcccactcgtcacggtcaaccgcacccattttcaaagaatcagcataactcgcgctattgcggccaatcacaaccgtcaactcaagcttggtcgcaacaggtggcagctttgcaatattatcctttgtcaccgaaaacccaacgccgccgcccttcatcagttcatcaaacatgaaggagtatggcatcgacacagccggctgcgaggcgggataatcttcaggcacaatgtgtgcttggccataaggttgcgggcgaatggcgatgaaccagcaattgttcaaggcatcgccattgcgcttttgataatctgttccggaaatccacaaattacggcctgaaggtgtgcccgccaaaccataaatcagtttaaaaagattccgtgcttctttttgcaatgtttcaacgaccttgggatcaggattcgctgtatgtaggcgcggatcaaggttaatgttaccttcaaccacgcgcttgacggtttcgtcccagttttcagtgcgttgagcatctggcagccaccgagcataagtacgtttataagtgacccagccaagttcaccccaatgtggttttatttcttttttaacctcggcaataaaagctggtgccaaggtgattggtttcgtcataacttgcatatccgtacctcccgtatacaagatatggtatatcctcatggagtttatatcaagatatagatttaacaataacaactggttagatgacggtaactggtggccgacagtgcgttcgccttttccagaaaatcctaagcaaattaaaaaatcgtcagagcaaaaacgtctccgacgattcctatgtgttcaagttagaaaaccggaccaacatatggtcgaaccagcacatgtgctaaatctaacgtcttgagctcggcaatttcttgaacaaaacaagtgatcgagccagctaacatcaggttcattggcatcttgccaacttgaacggcgacgatcggcatatgatgcgcataggcgtacccgatttcaaaagccgtgccaggatcaggtgtatcgccaacataatctaggatagccaccatggttgtcgcctgatgcaagccttgaatgtcttcaccaaagacctgacgctgccagcctggtgagttttcttccaatttagctttattagtatcatcgcggggtgagaaaacaccggtcaccgacttgttgacctgcaatgctgccaagacttgatcaagtcgctttgtttgagccgcatcaaagaatggtgcggcgacatagatttgtgccatttagtttcctcccacttttgtgacgtgaccagcagcactaaaaatcacgctgccgctgccataaatattcaacaatgtcgtgatcgacaagccgattttcatgcaacaggctgtgtgcagcccgcgggccgcggatcacgacctcggtataatctttgatgcggtctttgaccaaatagcgaattgcaaaactgctattgatcgccacttcaccatcatggcggccgccaattagtaaatcaccagcgatattcagccaccgcagatttgccggtaaattaccaattgtcttttgaaactgttgataaatcggtgcagcatgttccggcccggtgcgggtcaaccgccaatttaagattggtgatcgttgcgccacctctaaatcattcatcggcgcagcaatcgtgactagattagcgacaggcactgtcggcttgctcaaaagatataagacagctgtgacaccacccatcgaatggccgacaatgttcacctctgcaaacgcctgttgcgtttgcaacgctgcgattaccttttccaagccatgcaactgagctgctggacgcaccgccttatctgtgaacaacacttggactgctgcatgatgatttaggttaagctgcccacgcaaatgcaccttgccatctggcgcaacaatcgctacaacatctttgctgagtccataacggcgctggagccgccagagcatatgcccaaacgaatagcgtgtgccaaggtgcccaggaataaacaaagtaggtaccggatccatcaccagcggaaccggttgataccccggccgtgccagcaacaaataatctgccagaccgcctacaaccacgacaagaccaatggccgcaacgatccagaaccagccgctcatgagctaagcctacagcttgtcgacttgatcgaaatccagttccgcggtaacttcgcggtcgaacatttcggtgacaactttcaacttcatcttttccttatcaactgccgtgactttaccgtgcataccggtgaaggcaccatcaataatcgtcactggttcgccaacatcgaattcaacgtcattgtgacgggtactcatacccatagaatgcaaaacattggcaacttcttcaggcaatagtggtgcaggcttagagccagcgccgtgagaaccgacaaagccggtcacacccggtgtgttacgaacaacgaaccatgattgatcagtcatcaccatttcaaccaacacgtaaccagggaaggtctttttcatttcgatcttctctttaccattcttttgttcatgttcttcttcttcaggcacaaccacacggaaaatataatcgtccatgttcatactgctagtccgctgttcaaggttggtcttcaccttattctcgtaaccggaataagtatgcaacacgtaccagcgtttttctgccgatgtaactgtttcagccataatgcgtctcctttaagtgttttgagtcaaaataaaaaaccgtcatcgaaggcggtttttgcactgacaagagtataccaaaaaattggcggtttgtcaggcatcagtataggaaagcctgaaagatcatgttaatgacccaatcaactgccgcaaaataaatggcaaagataatggaagtcatgatgacggtgaaggtatcacgccgcgtttgccgagcagtcggccaagtgacggctttcatttctgcgaaaacacttttgataaatttcatcattctgctccttccatgtttactttgtctcttgatggaccgttacccggccacagtgtttacaaaatttttttaaggttaatcgttctgttcgttttgggttttcgggaacaaaataattccgttgcccacaaaccgagcaagcaagtgctactttcttagctgtcatcatgttccctccagtcacgtccaatatcttaccaagattatggggagatggcaagcagtgagggtgagccataattttttcgtaggacttgggcttcattcaatcccgaataatcgtaggaagatcctaggcgaaaagttttcttgccgtgccaaggcaaagcaatcaataatccatgagaagtcaaaaaagaatacccaaccacagcgtcagcaacaacgtaccaccaacagttaataatgattgaatcgtgaaaataaaggttttatctttacttggtttgcttgtgtaacggcgagtattgttgcgtactagcggccaagttgctagcactagcaggctccaaaatggtaacgcgcgggttaggacacctagtatcagcgcagcgaaagtgatgaacgggatgaggcggtaccattgcaaggcgcgtttgcggcctaggaagtatggcaaggtgaaacgctggtttttgatatcttgatccatgtcggcaatgttgtcagcaaacatcacggcggcatttagaatgataactggcaaagccgcgagtaaaagttgcaggagccagcctagatcaaatgaaaaggtgaaggtgcgccgtcccaacatcaaattaagcggacttggggcgggcatgttgatcagcacagcaatgatgaaagcaccataaccttccacaaaaccggctaacagctcacccaggggcaggcgggacaaaggaaccgggccaaatgtatacagaatagccacaccaacaccaatcgcgccgatcacgagcagactaaggttggtgcgcatgaccaaaatgatgcctaatatcacactcaccagcaaaatcacgatggtcaaggcgagcatcccccacggtgacaggtgctcacggccaataatattttgccgttgctgatagctttgatctttggctttaaaataatcctgaacattgttaaaaccagtcacaaacaaggcaatcgctaactgcgcaagcccatagatcaggctgttgacccatgaaaattgctgaaatgcccagcctgcatagctaatgcccagcacaaatggcaacatgctagccgccttagcgggtaatcgaataaattccagaaaaagtggccaagttaaccgatgatatggttcgctcataggatcgcccccattcccaagcccaagaccagtaaaccattttcaataacgagattgatgaccgcagtatgaaaagtacgctgtttgctggggtcacgaatgaatcggtggacatttttgatcacaagcggccaagcaagttctatcaccaacgtccaagctggcaatgcgccaaaaatgacgccaaaaataatggctaaaaacccaacatacgccagcagcgcatacacgcgtggcgaccaccagctacccaaatacatcggcaaagtgtgccggtgattacgctggtcctcatcaagatccgacatgttattggctaacataatattagcaatggttgccataggcgtcacgcaagccagccctaatgcaatgatggcaataaagtccccgcgcaagacaacattcggccacccaagatccagtgccagcaatcgacccggtgcaatattgacatacgtggcaatcactggaatgcccagtcccataacgataccagagaagatttcaccaagcggcagccgtgacaacggtaacggtccccatgtatacaaaatgccaatggcaaaacaggccatgcccatcaataatagtagccaatctgtccgccaaaccagcaccaagccgatcaatgaggcgacaatcagcataccgataatcattttttctaccagcttgggcgctaaatttgcccgaccaatgatattggtggttgtttgataatgtgtatctttagccttacgataatccatcaaattgttaagtgcagtggtcatcatgtcaaaaagcagcatcgccataaaaaacaggatcgtattcacggcattaaaagtgtgaaaatacgtcaccgcaaataaagtgccaatcgcaaacggcaagatactcgcaagtttcgtgcgaatttcaacgagctcaaaaaataccgacaacggcataaactacccccttatttttttaacgtcgcaagtgtatagcctgaatccttcaaaagcttaaacttgtccttcaaccctgagctgacataaacctttttatctttcgtaataaaaatagcatcggcatacttcagcttttcaatataggccatcccaccagctaagcccttgtcaaatgttgcggttgacaaggcatcgccatcgacactctttttggtcacaatggaaacgcccattaagttattgtcgaacggatagccggttttaggattcatcaaatgcatatagattttcccatcgaccttgagataccgttcataaataccagaggtcacgaccgtcatgttgctagctggcagtgtgccgatagctgtcccgcgcggcttcttcggatcttgaatgccgacgttccaatcttttttcacgttctttgggctcttgcccatcacataaatattaccgcccaagtcgatgatcgcggtggtcactttcttggccttgagggttttaacaacttcatccgtaataaacccttttgcaatcccgccgagatcaatcgccatgccctttttcttgagataaacggtttgcttcttggcattcaaaaccacatccggataatgcaccaaaggcagacgctcatcaatttcactttgtgctggctttcgagcatccgcaaagcctatgtgccagagactggtaatcggaccgattgccaaatcaaaagcaccctcggaattttcgctgtaatgtttggcagcagcgatgacacgataaacactgggggtcacgtgcacaggtttgatgccagcatttttgttaaccgcatccacctctgaccctttttgattgaccgtcaactcatcagccaattgttggacgcgggcaaacgccgcatccaaagcaccttgcttgtccttgtcatagattttcaccgtcaccacggttcccattagaaactgggtatccgaatacggatcgccttcgactaacgtgcgctttgctgccgttttgccggcacaggccgttgcgactaatgccagtaacatcagcagaacgactacaaatcgtttcttcatcattttcctccaaacgtccgcaggcttgaaacctactcacgctctgtcattatatagggactttgcggcataagaaaagaacctgttcaaaaaagttctgaacaagttcttacttggttgagcaatcgtactagaccgattgcatcaccgaacgtcacaaaagtgtgacatcacattagttgttataaacaatattgtcgacttcaatcttgttagtgttgccattttgagcagcattgacaagttggtcagcatacaagatgaaggtatcggaactgtgggtcgcaccggaaacaacatcaaccttggctggtgactgtttagcaaccagtgacttattcagttcaggaatgtattccttagggccgactttgttgaccttcttcatatttgcttcgtacttcgtatcaagcgtcttggacttgccatctttgttgatgttgtcgtagttgctctctgtgatcttgccatccttaaccgtgatggagaaggcgacacgataaccgttgaagtagttcttttcttcaagtgtgtaggtcccgtcctgcatcttgccggtgttgttaacttcgattgtctttgtatcgccagcttgtgcagcttggatcaattgctgtgcatagttcttaaaggtcatactggaatcagtcgcaccagagataacatcaatagcgccaacgttggttccattcttttggaaggacttgttcaattctgggatgtattccttcgggccaactttagccttagccttcattgccttttcataagcggcatcctttgtcttggacttgccgtctttgtcgacgtaatcatatttagtagaagtaatcttgccatctttaacggtcatcgccatttgaactttatagccatgatcatagccggtttcatccaacttataggtgccatctttcagtgcaccgccagcaacctgtttctgtgatgatgatttcttaaccactttgctgctagatgctttactgcttgttgaatttttactgctggaactactgctgccacatgcacttaaaactaaagcagacagtgcaacaacggctgtccccgtcacaactttacttaacttcatgacatttaccccttttgcagttagttactgcgatattgtgttttcaatcacataattagtttagctagtcacttagaaaaaatcaacttattacgggtattataagcgctttctcattttctaatatcgcgacgtagaccggatttctgtgtttttttacacaaaaatgttcggatttagaaaaagacgtccggaacgttagacattaagtaaaattaaaggctataatggcttagacacatacttgtgaatagtatggtaaagcaaatggtaaggagtgttatgcatggcgaaaaccaatatcgtcgtggttggcgcggggtttgccggggtatatgcgacaaagcacctggccaagcgctacaaacgcaataaagacgtgacgatcacgctgatcgatcgccactcgtacttcacctatgtcactgagctgcatgaaatcgcagcggatcgtgttccggaagatgcgattcaatatgatttgcagcgcctgttcaaccggcgtaagaacgtcaaggttgtgacagacaacgtgacaggcattgatcgtgataagaaagaagttgtcacggaaaatggcagcttcccttatgattacgtgatcttaggcatcggttcgcagccaaatgactttggcacaccgggcgttgccgaacacggtttcactttgggtaagtgggaagacgcgattcggctgaagcggcacattgaagatgtcgttcgccgcggttctgaggaacacgatccagcaaaacgcaaggcattgttgtccattgtgattgttggttccggttttactgggacagaaacaatcggtgaactgcgtgactggcgcgacacactggcaaaacagtacaaacttgatccaaatgaaatccaattcagcttgatggaaatggctccgaccattatgaacatgctggatcgttcagatgccgataaagctgaacgttatatggaaaagcgtggcatcaaggtcatgaagaacactggcgttgtcggtgtgcatgaagaccatgttgatttgaaagacggctcaactttcccaacctgcaccttggtatggacggctggggttaaggcaactgaccaagcgaaggacttcggtttgaagcaaggccgggctggccggatcttagtaaagaacaacatggaatcccaagacgatccaagcatttatgttgttggagatgtttccttagttgatcaagacggtactggcaagggccaaccgcaaattgttcaaggtgctgaagccactgcgctgactgctttgaccaatattgaagctaagcttgaaaacaaagaacaagttgaatacaaagcgaactattctggcttcatggtcagtctcggttctaagtatggcgttgctaacatcatggggtggctccatctttccggcttctttgcgatgttgatgaagcatttggtcaacatgctctacttcatccaagtttattccggttattatttattccagtacttcatgcacgaattcttccggacacgtaacggccgtaacatgttccgcggccatctgtctcggcaaggtaacgttttgtggacacttcctgcccgcctcacgttgggtgccatgtggttgattgattgctggccaaagattcaaggcaaggaatcatggttcattgataaactgcgtctgccgttcacgtggctgcagccagccgcaaccagtggtgcttctgctgctggtgccgacgcaaccagtgcagcaaccggcgctgctgccggtgcagcaaaggcaacgaagactgtcttctcactgtcctatcagtatggaaacgatccaatgatggtctttgaaaagatgccaaactggtactacagtatcaccaaggcattgattccaaatcagcaagtcgccttctttatgcaaaaagccatgaccatcatggaaatcttgattggccttgcattggttgccggcctgttcacatggttgacctctgcagcgactatcgcctttgtcggtgtcttctgcttaagcggtatgttctactgggttaacatctggatgattccaatggcgttcgcctgcatgaatggttctggccgggcatttgggcttgataagtgggttgtcccttatctccagaaagtcttcggtaaatggcgttacggcacaccgcgatccttgtacggtaccgacacgcttaaataactgtctacacaaaaggctctgggtggacttacctagagtcttttttcaagagcgggaagctgttgtgaccatcttttccggccatagctgctccccgtccttcgtgttcaggcgtagcataaactgcatgccatgaacatgaacttatccagcggtttagattggagcaccagcatgaaacagcccagcacattcaaacgttatctcaaaatgattcggcctttcgattggatcatcgttggcggtctgttccttgcggccttcattccttatgtcatctttgcggtacacgagaatcagcagcaacaagctgaaccacaacgtgtgctcacagccgtcgtcacgcatgacggccatgaggtttaccgcaaacgactgactggccataccggcaccagtcgtttcacctaccgcgctaaagacggcgattggaacaaaatcgaagttaaagatgcaggtgtcgcaatcacagaagctaactgtcaagatcaggtctgtgtccggcgcggacgcatcaccaagcctgggcaaaccatcgtctgcttgccgcataaactgctcatcgaaattaaagcgaacaaaggcggcggaagtacagggggtatggtgactgaatgagcacgtataaagctgaccgtacccgacaatatatttatattgccctactctgcgcccaaggggtcattattggcctccttgaacgcatgattccgttcccgttcgcctttgcacctggggccaaactaggcttagcaaacctgattaccatcatttctctgttcacgatgtcgatccccgacagttttatcctaatgtgtctacgtctcttgctcaccaccctacttggcggcacgctttcaacattcctttacagcggcgctggtgccgtcttgtcttggtttggcatgctgctcatcaaacaattaggtgaaaaacgcgtcagcatgatcggcatctcggcagccggcggcattttgcacaatgttggccagcttttagtggcatcgttgatcgcccaaagctggactgtcatgctttatctgccggtacttgcttttatgggcatccttgctggcatcgcagtcggcatcgcagccaactttctttttgaacacatcgatatcttgcggcgactgcgctacgaccgaaccaagcgccgcaaaaaaggagctacacatgaaaattcatcccatgtggcatgaatacccaacgttagcgccggagctggcttcagcgctagccatgatcgaaaaacagatcacgaccaacaacacaccggtcgccaaggcaatcatggagatgatcaatggcggcggcaaactgttgcgtcccgcttactgtctgcttttttcacggtttcaagacgttgatcgcgagaagatgatcgccttggcagcggccattgaaaccctgcacacagcgaccttgattcacgatgacatcattgacaaatcgcccacccgccgcaatcaggtcaccatccagaagcaattcggaccagacacagcggtctatgccggcgactaccttttcgttgtctgcttcaagttactgtcgcattatgcgtcaagcttacgcagcattcagcaagacagcggcagcatggaaaagattcttaaaggtgaactggatcaaatggccacccgctaccaaaccaagattaccatcgacgactatcttaaacaggtttccggtaagactggccaacttttcgccctcagctgcttcatcggtgcctacgaaagcggcagcagtcccacctttgctaaaaacgctgaaaaaatcggcatgaacattgggattgctttccaactactagatgacatcctcgattacaccagtgatgacgacactctcggtaaaccagtgtgcgaagatgttcgcagtggcgtctactctgcacccttgatcctggccatgcaacgcaatcggcaagctttcttgccactgctagcaaaaaaagatcagatcaccgatgcggaaatgaatgaactgcgccagctcgtcattcaccatcaaggcgttgagcaagcttacgccatggcccagaaacgaactgaacaggccatcgccggtttgcaaaaactaccagcaggcgctgcgcaggatgatttgattcgcttgacgcagagcttgttgaatcggaaagcttaattgaactggcgtgatcgtcgctgatggatcataattcctgtactgaactcgtgactcattagaatccgcgtaatctagtaaaggtctaaactatagaatcctttgccgtgccaaactccgcaatctccggccagatgggtggcgacgcgaagctagagcggtgacggcgcttcgagcccaaagcccggtctcgaagtcgccaaacaacatcagctccaagcccggtcgctgtgttgtttgcacggctgagccccatctggcctacgattgctccgccttggcactgacgtctttaaagctgtcttagtaatttaaatttatccatgcagaaacaaaaaaggcacagccaaaagtagttgctctttgctagcagcatacttttgactgtgcctttttaattttgttggatgaatggctcgccgtcagccattttccccatacttaagataaagcccttcgccattggtcacttatccaaacggtggctggcagcgcgaccacatacacgaccaaatcaaatgaggtaaagtgcgtgtcatagagcttaaaaagataaacgctcgttaccccaagtaatattagtttgtgctgccaaaaccatcgaagggtttttcttcatgagtgaacctcattttgactgtctgactcgctttggttatctatgaaaccgataaccatcaccgtttgacattattgattgtcgccgtcgtgcttttctcgttgtgccataaaataggtgtaagcaacctgcaacgtccagataatagttagaaatacagccaagatcaccgttatgaaaacactgcctgatgtccatgcaatcaatgcaatggccagcaccccaaaaggaaacatccacaaggtccgacgaagcttgccacgataactcatcgccaagtaattgaagcctcgatccttatttttattttccactagtgaaccccctctcgctgaaaagatcggttacaaataagagcttttgctaaaattggctctcagcatagcatgattgatttttacagacaacttttgatttacactagtagcaaaaagacaagacgcctcagccttcaataggccgtacgccttgcctttataacaattccatcacttatgggtctgcgctgcgacttctttgccaaactcggtttgatcaaaatgatcgatgatgtccttaagctcagcgtatcgcagactggcgccgaacaatggactacctggttcagtcatgatgccgtctgctaagttattgtgcacaacggtatcaaatcccatatgatcgacaaaagccgccacagtggcaaccgcgtcgggatcgttgccggtcacaaacagtgctttgcgtttaggatcgcctttgggccgcgcctcttcttgcaaattgtgatagcccatatgattgaatgccttgacgatcttggcatctttgaaataggtctgaacttgttcactggaagtcgtacttgggtctaagacttcttcgcgaatgccatctgtttcccaccagtagttcatcgcatcaatcaccaacttgcccttcagcaagtcggcatcaatgttcttgtaacgactgagtggaattgctaacaagataatgtcactgttagcgacaacatcagcattttcggacgcgattgcaccgggtactagcgttttaatggttaaggcgatttttttgactgatcccgaaccggaaatacgtaccgtatagccggcatctaaagctagaccagcaaggacaatgccgacttttccggcaccgatgataccgacgcgttgaatagccatcatttcaccgccgccttttctgtcagaatttccttgacccgcggaatgactttcgtgccatatagctcaatcattcgttcgcgttgtgccgccgtttgattaccagccccgtagacaagatcaaaccggccgagatcaagcaagtcaatggtcgttgccatgcgtcgggccacggtctctggatcgcccacgtagaaagagccgactttggtttcgccttcaaactgttcacgactcatcggcgcccacccacgcgttaagccaatacgatcaaaattggctttgatatttttaaacgcaacttcaacggcttcgtcttcgtcatcggcaatgaagccgtgggaatggacggcaatcggaaattccggtttgccgagttccttggccgccgcgtgatataactcgatatacggcttgaaccggctcgcctgaccaccgatgattgcgatgatcactttgtagccaaaattgacggcacgaatcaccgattccggcgaaccgccgatgccaatgtaagtttcgagtttgccgttttcggttttaggatagacttcctgatttttcaaagcagctcggaatttgcccgaccaagtaaccgccttttcattgcgcaaagcatcatacaaccccagtttctcgttgaacaagtcgtcataatcggttaaatcatagccaaataacgggaaggattcagtaaatgaaccccggcccaacatgacttgtgctcgcccattggacagtgcatccaaggtcgcaaatcgctcataaactcgtacaggatcatcggaactcagcacagtcactgctgttgcaagtttaacctgtttggtgaccgccgaaatagccgccaaaaccgtttccgggcttgacacactataatctgctcgatgatgctcgccaacaccaaaaacatcaatgcctaagtcgtcggccagcttcccctcgcgcacaatttgccgaatagaagctgctgcagtttgcaagctgccgtcttcatttgccacgatgtcaccaaaagtttccagtccaaattgtaaatgctcaatatctaccatcgaaaagcctcccaaccgataatgcttactttttgtaagttgatgatattatcataggcttttttaaggtgcatggcaaccttttggagggtgaccagtcacacgatcaaatataggattaagccggctatagaaaagtgacttccaagttgaggagaagcctgcagtcaccaaagcaatgcgaaccaatacatcccattaataccggcatgttctcatttgataaatctcacctgcgatactgctgttagcgtcttgtcatcaacaagaaggcaacaaccctaaacacgaatataccggcctactggttacgtttctggctccccaaatgatattaagagcgcgctcacaagacacacttaccgtctctctgcggtatgcgtttcgaatgcttcagatatcggtaaaaacaagtttgactctatcttcacaagtcgttcatttcgtgatagcttattgattaaccaagcagtcttccattgatcacaacgaaggagcaaattcatgaatctacctcaacggcaacatgaatttttgttgacccccaatgctaatctgcacatgcgtcccttaacatactgtcttttaagtacacttctattcgggcttcccttcagtgccttcatgaatatgctcatctcctacagaagactttgggcagttctttcagttgtcgtcatatgtctcacgatcttccttgccagcattattacagtcatttcaaacgccaaaaaagagactttgccaagcctctttaaaacaaaacgacgatggttaatccaattactaggagcccttgtagaagctgctttgtttctcttcataaaatttttaactagccaatgaagcatcccattgtacaagatcaatattgaatgactgaaattgctggaccttgatcccgaaagtttgttggctactaatgtttgattgcaaaaaaaaaagacccagtaacttctcttgttctgctcatcctggcaggacaaaattgaagtccactgtgtcttttttaatgtcatcaaatttgagaaggctgggtcatccccgtaactactctttcggtttcggccgccgctctaaatgccggcgcattttgtctagcaagaatagctggtcgttattccacggactgttgcgccgggcgagatgggcggcgtagttggctgtgtcgtggttgaattctcgatcagagcgctggacttctttgagaaaatcgcgggagctgatccgcaaggcgccgcgggagaagacggtccattgttcagcttggtcgctagtaacgacgacaagctgcactagcggcgagttcatgtcctgtgcgaggcgttcaatgtaactgtcagcggtttcatcttctttggtgaagacgacttgcagatcccatttggcataacttttgccaataccgggcacgtacatcgcatcgaagaccacgatcattttagcgttttcgtggctgcgatattctgccagaatgtccaacaagcgatcacgggccacatcaaaatgatcctcagctttgagttttgcaagttccggccagttgccgatgacgttatatccgtcgacgatcatgatgtgttcgcgcatttattttccctcatgccgactggcgaatgcctgatacatcaggatgcccgcggccacacttgcatttagactctgaacgtggccgaccatcggaatcgcaatcgtcgcatccattaacttcgcaacgccaggcgagatgcccttgccttcattgccgatcaccaacgcagtactgccttttgcatcccattttcgataatcctgaccgtccatagcagtgccaaagacccacatgccgcgttctttcagcgtcttaatggtctgggcgagattcgtcacccgcgccaccggtacatactcaatcgcccctgtgctgactttggcaacggcacttgtcaggcccacagcgcgatgcttcggaatgatcaccccgtgcaccccgcttgcatctgctgtccgtaaaatggagcccaagttgtgcggatcttccaaattatccagcaataggaaaaacggatcttcgcctttatcagcggcatttttgaaaagatcatctaaggttgcataggcgtaaggcgtcattgccaataagaccccttggtgattgccttggtcactcatcagatctaatttttgcttaggtgccgtgctcactaaaattttctttttttgcgccatgccgaccaaatgctgaatcggttcacttttcaggtcggtttggacgaacaatttgttgatggtggcagcggtgccagctttcagcgccgcctcaacggcatggcggccaaagataaactcatctggatcatgttcagttgttgcttgcggcttttttgccatgtcccgtcttcccttcttcaacgtattggatacaccatgctgctaattcagcaacacggtcatcgcggccgatcaaatgtaagtagccgaacagtgcctcgaatcctgttgaaactcgataagtcaccacatcggtatttttcgcgtgcgtgtagcttttggcattgcgcccgtgcttgaaaatgtcggtttcgtcgctatccagcaggttggcttcctccatcccagcaatcagcgccgcttgtgcctttgcggacacaaaatccttggctgcccgttgcagtgatgccggtcgaactaaaccgcgcttgagtaagtgttctcgaatataaacttcataaaccgcgtcgcccatgtaggctaacgcgataccgttcaattgttttggatcaaatgtcattgtctgcgccaccgtgttccttgaggagtgtcttccaaaataatgccttgtgcggccaactgatcacgaatttggtcgctcttagcaaagtctttcgctgcccgtgccgcatctcgagccttcaccaaggcatcaatgtctgcatctaggctcttctgatcagcaaacaccacaccgaagatttgcagccaagcatcgtattcattcaaaaggtcattgatactttcacttttgaccgtctcttcattagcatattcattaagcaactttgccagatcgaataaaacggtgaggccattttgaacgttgatatcatcatccatggcagtcacgaagcgatccttcaaggtttgcagctgcttggtaatttgtggatcaacgccggtttcggccccgcgacgacgataggtcaaattctcacgagcaatttttagccgattgagactgttggccgcatttttgaggttagtttcagaatagcgaatcggcatccgatattgggtaccagccatgaaaaaacgtagaacttgcggatcaactgttttgcgaatatcgtgcacagtgatgaagttgccaagcgatttgctcattttctcgtcgtcttcaccaatcgtcacgaagccgttatgcatccaataccgaacgaactgcttgtcggttttagcttcgctttgggcgatttcattctcatgatgcggaaattccagatcctggccgccaccgtgaatgtcaaaagtatcgcctaacagcttggtgctcatgactgagcattcaatgtgccatcctggccgtcctttgccccatggtgactcccaactgatctcaccgggtttggcggctttccacaaagcaaaatcaatcggatcttcttttttagctaattcgtcctgggtaatatgttgactggcaccttcttcaagttcatccacattctgatgagataactccccataatgtttaaacttgcgggcccggtaataaacatcgccgtcaacagcataagcgtattctttgtcgatcaaatcctgcacaaattcaataatatccgggatcatttgactggcgcgaggatgagccgttgccggttcgatccccagcgccgtcgtgtcttccatgaacgcatcaataaaccgttgcgccaagtccagcggagcttcaccggttttatgagcagcattgataatcttgtcatcaacatcggtgaagttcgaaacataggtcactttatatccgcgatattcaaaataccggcggatggtatcaaacgcgatagcactgcgcgcgttaccgatgtggatgtaattgtaaacagtcgggccgcagacatacatccggatttctcccgggtgcaacggcgtgaatgtctcttttttccgggacattgtattgtataacgttaacatcggctcatttccttcctgtagcgtcttaactgcattttacaggaaacgaccgtgattataaaggaacggggcgggcgattgcaacattctgtgccgtgccaaacgccgcaatctccgccttggcactacgaccttaatgcttagcagactatctatcaaaaaataaaaaggaatgattttcctaaatacggcaatcattccttttggagctgcgcatgacgttcctgtttttcagcagccttaatcaattttccgcttcggattcagaatccccaacggatcaaacaatcctttaatttgatgctgaatctcatcaacatcaaagcctaattcttcattgttccattggttcttgctcatccccaccgcatgttcaccggaaatggtgccgccaagtgccaatgctttgcggaacatcagacgaatagcctgcagcgcttctttgggcggttcttcctcatcagccggccagatgacggttggatgcacattaccatcgcccgcatgacctgccgtgtaaatttcgacatttaagtcctgtgcaactgacgcaatatagtccatcatttcaggcagtttagacaacggcaccgccatgtcttccataatatgttggccgttagcgaaaaccgccggcaacatgtcctgacgcaacttgataatcgccgctgcttctttgggatcactggtgaccttgatgtttttggcatgatcgtcatttaaaatctgctccgccattttcagactagcttcaccgccagcatctaaccggaacaggagcattgcctcggcgccttcagcatagtgagtgccttcataacgatccaacgcagcaactgtcagaccatcaagtgcttcaagcatgaccggatagataccggaaagccgcaaatcctccacccctttagccaatgctgtcatgttgtcaaaataggcaattccaacaaccggcgtgccaattggaatcgggttcagtttgacagtgacttcagtgatgatgcccaatgtgccttccgagccgacgaataagtgcgtcaaatcgtaactaaacgcatgcttgtaagtgcggccgccaagtttgatttcacggccgtctgccaaaaccactttaaggccaagtacattgtcggttgtcgccccatacttcacggtgctcatcccaccagcattggttgccgcattgccaccaatgcttgaaattggtttagatccaggatcaggtgcgtaaaaaagaccttgcgcacgcgctgccttatccaggtccccgttgatcacaccaggctcaaccactgtcaacagatcgcctttgctaatctctttaatccgattcattcgcgctgtcgacaaaataagactgccgttgatgccgtcagaaccgatcacggtgctcgtatctgcgctttgaggaaccactggcatatgatattgacgcgcgatttttaacacaccttgaatatctgcaacatcgctgactgcaacatatgccagaattttcccggcgatctcacgctgggcattgccattggcgctatgttcgcgcgcgattttatcatcaatgtggatttcggcatgcggggccgcgtcttgcaaggctgccagaatttccgagttatcataagctgtaaaaattgccatcacaaaaacctcctcaacacctctaaaggcaggtggcagcgttggccattcgcctctgaagcatcgactttattatggactattttggtaaagatggcttagtaagacgctcggtggtgtgcctattaagacgccgattgaccctgcgatgagattgactgtcttgcctttgtctcaccagcaatggtttccttgggatgaacggtaataacagcctctcctaaccaagtcgtttctggtgccatggctgccaagcgataaggttgacgtggttggccgctgcctgttattggcgttggtgtggcaacacaaatcgtcaagacatctgtgtccacaccagcgtctgctagatggcgaaagcggaccaaattaatggtctgttcttgtggcaccactagtggttcgcagttgccgcgataatcgagtcgaacgacatgccggccatgtgtgtcaaaaccagataaaacggccacctctggacgaccaagtacttgagttcgcggatcaaaaccgtcaaagctggcgaaacgcggcaatatgtaatagaagatcggtgacgccagggccacaggttccttgcttagtaaatgcaggccgactttcccaccaaaacagccggctgcagctgatcccggcaaatattgcaaggcaaaagttggttttgtggtcaatgtgtctaacggttccttgtcgttattgcgattgtcacgcatcagtggtcactcctgtcaaaattatgcttgatataattaaaatgatactcgcttgatccataaaaacgcacgttataagattttccgaatttttgctgacgattcaatccgagccattgggccagattctccaagtaagcctgaaaaagcgcgtctgtgttgcggttatcaaaaaacaggtgtttgttcacggaccatcgtcggtcctgaacaaacacctgcagttgtgaaaaatcacaacatgaactcaacattaggaagacaacgacgaaaaccagaaaaacatgcgctgtccattaatcatgccggggattggcttatcaggtcaatgaaaaagccaggcataaatgatatgaaaaatcgctgccgtcaccagtcctgtcatcatacccagaacaaaatataaaagtaagtgctgccgcttacctttcatttttcattcctacccttcctacgttgcaaggagctattctccctgtcatttagggtaaccgatgtcgacaagttctggggaaaataaatataaacgttaggaaatcaccgattaacgtcgtcctttaggcacactcactcatttattaacaacaagcgttgcccttcgcgttccaccaaaacctattgtttgcatgcaaaaacccgcacatctgcgcgggcttcttgcatcaattaaagttggccggtgacaagatcaacgtttttaaggacttgatcgcgacccatcagttcaatggtttcagcaagttgcggaccatgcatccgcaatgttgcagcgattcgaattggcatgtaaagcttgcggcccttgaccttggtttcctgcttgacttcattgacaataccgccaatggaataagcgtcaaacgtgtcgagtgcccgaatctttttggcgaaggcttcgatgactggcttagcattgtcatctgccagttctttgcgttcgtcatcggttaggtcagtggctttgtcgaagaaaatatcggcaagcttgctgatctgagcggtataactcatttgatcggtgtaaagactaataagctggcgcgcccactcgatggtcttcggatctggatcactatgaattttgccatcttcaatcaagttagctaaggacaaactcatcaattcattcgggttcgtcttttgcttggccttgatgtattggttgttcacccattccaatttcttctggtcaaaacgggctgggctcttagatagccgctttggatcgaattgcttgatgaattcctttttggtgaaaatttcatcttcaccaactggggaccagccaaggagcgtaatgaagttgaacatcgcgtctggcaaatagccaagttcacgatattgttcaatgaactgtaacacggtttcatcacgcttcgacaacttcttaccggtggcgccgttaatgatcaaggtcatatggccaaaaattggtggttcccagccaaatgcatcgtaaatggccaattgctttggtgtgttggcaatatgatcgtccccacgcagcacgtggctgatttgcatcatatgatcgtctactaccaccgcaaaattgtacgttggcatgccatcacgcttttgaatgacaaaatcgccgcccagtgtgttggcatcaatcgagattttccccttaacgatgtcgtcccactcgtaggtcttgtccattggaatgtggaaccgaatcacaggctccaagcccttcgctttggctgcggcaatcgcgtcagctttttcagcgtccgtcatgccctcatattcatattcgtaatgcggcatctcgtgacgagccttttgggcttcacgatcggctttcagttcctcttcggtccgataagactcgtaggcaaagcctttatcaacaagttgcttgatcagcttgtcatagatgtccttacgttcagactgccggtatgggccaaagtcgccgcctttgtcggggccttcatcccagtcaatcccgagccagtgaaggttctccatctgactcttttcgccgtctgcaacattccgctttgtatcggtgtcttcgatccgcagcaccaacgttccgttgttgtgccgtgcgaacaaataattgaacaacgccgtccgcgcattaccgatatgcaaatgcccggtcggacttggtgcataacgcacccgaattggtcgatctgccaatgtcttagcctccatttttctgtaaacatgcactgatagtgtaccacagaagggacgttcattgggctgatgtgggagattgaatctatgtcagttggcttctgatcgttctactaaacgacgcaacctttgcaatctatcattgccttaatcaaacgggaatctcatgccccatgcatttcgcacactgtccatgatatggctgacatcgtgagatagtagcaactgaccgtcatcgtgaccttcatcaatgtagcgctgaaaatcacggacttcataaactaaggcatcggcctgatcgcctgcgcttaatacctcgctggtcgtggtatgggcatcaggggtgtaggttactttggcggttgtggcacgcggatagtcatcaatttcaacgtagccttttgtacctgagatcacgccgcgttttggctgcttagcgcgtaatgacagtgccatgacggccaactgctgatcagcattttttaaaatgatccctgattgttcatcaacaccggtctcaaagtacttgacggtggtgagcgttacattcggctgagcatctaagaacgtacgagcaaaggcagttgcgtatccgccgatatcaagcaacgcgccaccagccagatccttattgaagaaacgattctttggatcaaagtctttcaagctaccgaagttaacttgaacaagatgaatgtcacctaacttgccacttgcaatcagctgcttgacttgttgataaaccggcatatggtacaaggttaacccttcagataaaatcaggcccttgtgcttggccaactgctggacatcatcaaattgcttagcattgaccgtaatcgctttttcggcaagaacgtgtttgccggcattcaaagcttttttgatgtatgggtaatgataggtatgcggcgttgcaatataaatcacatcaacgtttgggtcggcaatcaaggcatctggatctgtatatgttttggcaatatgtttttcaatagcgaacttcttaagcatgtcggcattgacatcagcgacggcgtagatgctaccgttttcccggtttaaagcgtcggccatttcatgtgcgatccaaccagttccgatcataccccagttatagtttgtcatatgactcatcctttcttttaaacgcattctccagcccagaaacctgcgtgtaagaaccttggtcgcaatagtcagagtccgaccatcacgcctaaggccgcttacactccggtttctaaccgggctggttcacgctctgcttaatttcatgtacctgaccatctggtgtttctattaagagtaatgtcgctaagtgagcaaagtatgacgtcgcaacaactcccggtaatgaggctagcaaatgatcaacttttgcgatatccgtccattccgtcatcgtacaatcaattaattcattgccgtcgcgcgttcgcgtgtagcccatgtaagtggtagccattcgtcgttttgcctgcaagcctagcagcttagcagatgccctcacctgttcacttgccgcgctaacaacttccaatgtcagcggtaccgcggcattcagttgagcgttgacatttttctgagcagtgagaatcacataagcatggctcgcctgcgcgtgcaacttttcataaaaatgaatgccgccattacttttaagtaaattcaagtccttatcggcactgtcacagccatcaaaggcaatatcactggctatctgtgttgttgtcggtaaccccagtgtctgacaataagccagcgttacttcagagggactgcaaatctgaatacccggcaatgcccgtgcgacaatgccatcagcaagcgtctgcatgtgccgaccaccgccaagactcactacctgatgcggctgaataagtgctagagcagcggcgatttgatctgtcatgaaagttgcttcctctcttttatttttgatgaaattatatttcacgtataatgtaagactgaaatttagttttgtcaacagctagttgtgaggattgtcttttaaaattaatcgcgtagaataaaggccggagagtttcataaaacagattattcagaaatttaattgaaaaggagctgcgttatgagtattattgaccgtctttatagcatgctgccaacactgaccgcgactgaccgtaagattgcgcaggttgttctgacgaatcccggtgctgtcgtgaataccaccatcgccgccctcgcaaaagaaagtaacgttagcgaagcctcaatttctcgtttttgccggacaattggtgttgaaggctttcatcaactcaagattgagcttgctaaggttgctgaaaaccgtagtgcgtattatcaggaaattaacgccgacaatcttcagcaagccttaagcaatatcagtgccaacaaagtcgccgaaatcgaaggcacactaaaaaacgccagctcacatgacattcgaaaaattttggattcgttaaaacaagctagtgtaattttagtcgccgctgctggcgacacgcagccggttgccgatgacgccgtctataaattcaatcaactcggtctactagccatcacagacagttcttgggaaacggcgctcgcccaaaccatgaatgcacctgcagatgctttgttgctggttatctcaaattctggcgaaacgcggaatctcatcacccaaatcaaagccgctcaacaacgtggtattgctgtggtcgcgattaccaatcgcaaggattcaccaattggcttggccgccgattatcagcttttgaccgcggttcggcagcaaattttcgagtccgaatatttcttctcacgcgtagccgccatgacggcggtggaagccttattcttgttgcttctagctgaggataaaactttcatggcacatattaaggctcatgaagcattgattgcggagactaagatttaggtgttcgtcttagaccgactcttatcatttaaaaatgtcatttcttctaaaaaagagggatgatttttccgtaacacagaaaaatcatccctctttatttgcaagtatcaattatgtttcaaccttaactaggaaaagtctgcaactatgccgtcttcgccgttctcgtcatcacctgacgattttgacgccagaaccaatacgtaaaggtcaagactaaaattgtctgagcaactagtaggacttcttcaaccgcaccgttcagcgtaccaacctgcgtcagtgccgccggaaagtcgataaaggcatgtaagccgattggcaacaatagccagaaccagcgcatgcgtttcataatgatgatccacacaaccacggataatgcgatctgaaccgccaaggcgagtagtcgttccatcaaggataacgaaatcgtccagcccgtcgttgccatcaattgtttcacttgcctattgagcaccgaacgcgagctagcgggtaccttttcaagcatttcgtttactttgccgccattaattagcattgcaaacataaagttactgaacatggtcaggctgccaatcagaatcatttcaagcccgccatgacctaatccgtataggaatggtgtttcgggtgtcaccgccttggttggtatgcgtttattaataaacttaagtcctagataacggccaacctcttcaaaaacaccagctaacagcgcgccatacaacgcatatagaaacggcacatgttggaaatctttagcgatgccgcggaagggtccttccaatacaccagcgaataggaaaaaaacgcccatgccaataaagaaaaccttaacagcacctttttttggcttgctgtaacgcagaatcacccagattaacaaaataatcggtaaggcaaaacaaagtagcatctcaacgcccatcatgttaaccgtgaattggctgacagggctgttattcacaactttatccattctgaacacccctcaatcaagtataaaagaaatgatgacaatacccgcgacgatcaatagaaaaccgacaaggatcacccaactcatcgttttggccatattgagcgtgaacccaatccccaaccgtttttcaacaaagagcgccggatcagttggattatagtaaaacatcccccagacccaatgctgattatcattcaacacagatcctttggccgcaagtcggcgagtccccagaatatacaccaacggcaaaaagctgacggagagcagtgtcagggttagtgtgatgatcacaaaccaccattgaccttcagctgacatattcggcagcatgagttggagaaccagtaagctttgactcagaaaacctgtgaacagcagataatacaaaacggaattgcgcaccttaccagctcgcggttcagcagccggattgccgcgaactgccccgcgcgctctgcgggaaagataaaaagcacccagcacagttagcgtttcaaccgccagcgccaaaatcatgacccatgaatctgctgatgtttgctgaaaaccaagtacaagggctaaaaagaactgcggcaccaagacgagcccataggctgccggaaccagcgtttggggcttgagtttattcaggtcaacagtcaccttgctttgggtaagctcctgctgattccccatctctttaaggagttgcaaacttttccgatgtgccgccacaatcaaggcataattcagactgatcgaaagcaaaaaggcagcaatttgaatccaagcaagcgcagtcgccgcaaagtgcatggcggccgcaatcccaatgccaatcactgaaaggattgccgcccctgttaatgaaaaggcgagataacgacggcgtaattttttagctgctggcgttgtccaaatgctgttacgggcatatacaacgccgaataaaacatttcgccgtgacagccatggtgtgacagcctgaatcgcaaccaatatcaaccacgtaacaactaaaatcaccatttctgcttgcatctttaatcactccttcagatcatcataaagttcatcaatcatggtgtgcagtgcatcccgatctaaatgtcgggccactgcctccgcgacaaccttttctaaggcaggtcgcagcacctctgccactgcttgattcggggagccatgcgcgtgaacaacgacaccacgacctcgctggatctcaacaaaaccttccctttgtagttccttataggctttattcaccgtatgcagattaaccccaagttcattgcccagcgcgcggatagacggcaaaatagtgccattcgtcaagtccccagtggcaatgccactcacgatagcatcgcgaatctgcgtatacagcggaatcttagaatcgaaatcgattgtcagttgcacgtcttcaccttctaactgttctagttgttatagttagtatataacactgaacgctcacttagtcaacaattcacaactcaaaaggcgataagagcacaaaaaaagtcccacgcaagaaaggtcatcgtgagactctttacaaactcttttttacagatcaataactacttttcccgacgacgcagtccaaatgatccaaaactgatcaaggcaagcagcaaagccaccccgatcgcaattaagctggtccgttggttatcaccggtattcggcaagtaacggcttatttgcttggttgggataataacttcgattggcgcggtgtcattatcggatagcggtgccgattctgtcggcgtatccgacatacttggcaaaacttgagttgacggtgttgttggtgttgatggcgtgactggcgttgatggggtcacaggtgtcgcttgctttgcgtaaacgaacgtcacggttagactgcctgttgcaaaagcaccattttccgcgatgctgccagatgctaatcgtaagtagtgataattcgcgatcatcgttggtgtaactgcatacggatcgccgacatgaccggtcagaatcttatcaggcgcaatctgcttgccattgtcatcgacatatttcacgtcaacagttccttgagcaactggattcttagtgtagatgaaggtgacggtttgcgtaccgtccgtaaatgaaccatcttccggcgcactgcctgtcgccaaacgagcaaattggtaattcgtcatatcaattggtcttgcttcgtaaggatcaccggcttgaccagtgagtattttatcagatgccaaccgtttgccgtctacgtcaacaaacttcacgttgacactgccacgcggaattggtgtcttcgtataaacaaaggtgaccgtctgtacgtcattggtgaaagtcccgtttgctggtgcgctgtctgtggctaattggggattttcataatagtcaaaggcaggtgctgtcatcgtataaggatcaccgactttgccagtgatcaccttatcaggtgccaacatattcccctctatatcaacacacctaacgacgacggcattgccagttatgggtaaactacgattctgataaacatcggtgtctggcacagcgctcgttgtgtcatcgccagcgtctgtgacacccttagtcgaatattgaccggtttgatgaccggcaatgatctgggcattcatgccagtttcttgctgtttcaataccgttgcttgattagtcggcgttgttccagtcgcgttggtgaccactgaatgaatatgcgatgtcgatgctacaactgactggatttgactaccacccacacaaatcccccacacaaatcaacgctgccacccatagcgtacccgctttatacatcttatgctgagacttttcgttactaaatgcctgcaatgattttgcccccttctcatgacccaagccgagacgcgctcaaccgaaaaaaacaaagtaaatattacatattggtgacaagtataacacttgacatttttctatgtagctccagcacaaaaagcctctttcaattgccatattgcaattcaaaaaaagacttcatagaaccaagtctaaaagtctttatcaattaactaatattttgagtgtttaaaaaccgtctacgtgccacaaagcaatgttctttagattgtttaaaacccaaacctgaagtcatgaccagtccacatccgcaatccaaatgcttcttttatttagcgttcattacgatacttgaaaaccactagacttaaagccaaaaaaggtgctgcataaattagataaccaagactaatttgactaaggggcagccgcgtcaacttcgttagttcagcgttctgcaattgattgcctaaattcatcatgttaaccggattccattttatccattcatgttgtttgatcatcataaacatcaactgattaacctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcatggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgtcgccattaaacgtgtcacccgatcgacaatggtcaaaacagcagcctttgacccgcgaccaccgcgaactgtatccatctctaaatgtcctttttcggttcgccgattagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggttaaaaattgaaacaatgaagtatgtactgaggccaatgatgatagcaggcgttgagttttcaaacagcgttgcgagcagacaaacaaaactcaatatgaatatcagcgttaagaatgaggaaagattgttcattaaccatatttgccaaacttgctgtccttttatgccctttgcgactaaatcaatcttgccattaaaaactgttattgcgagacataagctcattattaagctactggcatataaaacgagcgtgcatagcaatagcgtcacccacttgcttgccaagattttgcttgacgaatatcgacgataaagtaaggattttaaagtgccgtattggatttctgacgataactgcgtacttgttaacgcaagcatatagaaaacaatcaaaaccggcgcataaaaactgttgatgaataatgaactagggttagaagcattggggtgggttaataagtacacggcaattgcaacttggaaaagggtcagaccgaaccagaaaacgaataatgaaggccttttgactagtttgtaactttcttgcttaactaaggtgaccaaaaaatgacgcctcctttttattttgttgatgccaaaacatccagtagagatttttctaagtctccttgcgtttcttttatatctttaatgacaatatctttgcgccataatagttttaacaggtcattaatgctagaaatggacgatcggctaatttttaaaccttgctcttcattactaaccacgtagccctgttccgctaacagtttctgagccagctcatcttgatcagtcgctatccaaaagtatgtttgacttttcttcaataactcactcatagtcgcatcaataattaaacgaccttgatcaataataatgacatcatcagcaactttttgcagttcactcaaaatatggcttgaaatgagaaaggtggtcccctcatcacgtttacggataatcaactgacgaagcgccatggtcgccttaggatccagcccattcatcggctcatctaaaatcaccagttctggacgattgacgaatgcaagtgcgattccaagcttttggcgcatacccagcgaatattttttggttttaacatccgcatatgctgcaagatgcaactcctcaatcgtttggttgacgcgttcatgccgctgaggaccattggcaaaaagaagcaattgttctcggcctgtcagataaggatacaaacctggatattcaataagtgcgcccacatgctctaaagcactatgattatccacggtgattttttgatcatccaattgaatatccccatcaaacgccgtgattcccaaaatggccttcatgatcgtggtttttccggcaccgtttgcaccaattaaaccaacaatatgcccgcgttttatctcaaaggaaatctgatgtaatacttgcttctttccaaagaacttatcgagctgatttattttcaacataccttgctgtcactgcccttccaatgcgctcaggcattttagactttaaaaatgctctatttggcatctttattatcctaaatgtaacatgtccaaattagataactgttgtttttgacaaaacagaaaattaacttatataattggttgctgtttgattataggaaaatagaggtgtggcacatgtctgagatgacaacaggttatctgtacaagaggatccggcttgaacgcggtttaagaattgcagatgtcgcaggtgaaatcagcgtcagtacagtttctaagtttgaaaatggccattccgagatctctgccgaaaagctcatgcaactgcttaataaattaggcatggatgctaccgaattttttgaaattcttgactattctcaacatcaaaaacacatttcgacaaacttatcgcaaaaaggttttataaaaacactaaaccagttaggccttgaacaagatattgacggccttaaaaaattccgtttacggttcactaaacaattcaataaaacgcaaagtaggctttgcaagttacaagaaattatcgtttcgtcaattcttctcgacgctcaaaactcccgagaattgctaccatcctcagattcaaagttcgtcaatgactatctgatggaaagagatgtctggtacacacttgaatatatgctctacggtgactgtatttcgtttgttcggccacaagacttccaacgactatatacaaagtttttaacaattcatttttctttcatgcagcgaagcgattatataaatctttttttcagtccttttacaatactgctgttgcattatactatcgtgataaattttcagaagccatccaaacgctcgatcatctaaaggaacaacagttgccggataatctattttttattcgattacagctacgtttattacgaaccttatgtttatacaaactgactaaaagccaagaaacagcaattgaattggcttcattactgaaagtcattttcaaaattagtcctgcctttggtcgtcgctggaaagatgaattccatttctacgaaccaacagctgatagtttctagatcaattggtattgattcaggaacttgcacgagatcatgaaagacagcaaaagaaggcagcttcagttcccgataagggatctgaagccgccttctttcatgacttaacagattatctctctttatcccgaattgccttttgctgatgcgctggctttgcgaagatcatgcgccctgcagccgtttgtaaggcactggtgacaatcacttctaacggtttgttcatgtagaacttgccgtcttcaacaacgaccatggtgccgtcttccagatacgcgaccccttgctggcgctcagagccggatttgatgacggtgaccgtcatgccttcaccgggaatgacatctggtttcagcgcattggctaaagcgttgatgttgagtactggcacattttggaactgggctactttgttaaggttaaaatcattcgtcatgacgatgccatctagcaatttagcgagcttaagcagcttgctgtcgacttcggtcatatcttcgaaatcgccttcatacatctcaatatgaatgtctttatccttttgcatggcattgagaatatccaatcctcggcgaccacgcattcttttcatggaatctgcggagtcggagattagctgaagctcatgcaaaacaaaattgggcacgagcatggtgccttcgataaagccggttttggcgatggcctgaacacgaccatcaatgatcacactggtatccagcaacttgtacttgcggaaatgatcgccgactttacgttctaacacctgatcattttccgtatctgcagttcggcggttacggaaactcaaaagccgccgccattcttcgctgcgtgtcgtacccacccgaaaacccaagtaaccgaataatagcatgatgatgagtggtaggaagatattcagcggtgcaacgaagccatagaacggaattgaaataatcgccgccaagatcaagccgataatcgtggataagctgccgaacaacaagtagcttggcgactttgtgttcagtgtcttctccaacactttcaaccgacctagaatccaacctacgctgaggcttgccaacagcaggaaaacaacgccgccaatcaagccgtcaattaacagattgttcagaaaatggttgtctgcccagccgatcaaatcccaaagcggcggcaaggtgcccatcccgaccccaatgccaatcaggccgaagatgatatagataattcgtttcttcataaaatgaccccctttcttagtttaattaaagaccttatgcagcgcttcggcaatgcttgtaacaccaatgacttgaatatcttttggcgcatgccagccttgcaagttgttacgtggtacaaaaatccgtttgaaacccagtttggccgcctctttgacacgttcttcgatccgattgacgcggcgcacttcccccgtcaatccgatttcaccgacaaaacaatctgtcggtgaaatctccttatctcgataagatgacgcaattgccacagccatggcgaggtcaatcgccggctcatcgagtttcacaccgcctgttgccttgagataggcgtcctgattttgcaacatcaagttagcccgcttctcaagaacggccatgatcaagctcactcgattgtgatccaacccactgctcgtccgtttagcattgccatacatcgttggactgatcaaggcttgaatctcgactaagattggccgggtgccttccatcgaaacaaccaccgcagaaccggttgcccccgccaagcgttcttccaagaagatttccgagggattggcgacttcctgtaacccgtcttgatgcatttcaaaaatgccgatttcattggtcgatccaaatcgatttttgacggatcttaagattcgatacgtgtggtgcatgtcgccttcaaaatagagcaccgtgtcgaccatatgctcaagaatcttcggcccggcaatcgccccttccttagtgacatggccaacgatgaaaatggtcacgcctttggacttggcaatgcgcatcagttctgccgtcacttcacgaatctgtgccacagaaccgaccgctgaattcatttctggcacattcatagtttgaacggagtcgatcacaacgtaatccggctgcatttggttgatgacgtcttcaatactcggcatgtcggtttcgggatacaagtacatccccgaatttgccacaccaagccggccagcccgcattttgatctgactggcactttcttcgccagagacatacaaaacggttccgccggtattagccaactgccctgatacttgtaatagcaaggttgatttaccaatccccggatccccgccgatcagcaccagtgaccctggcaccactccgccgccaagcacccggttcagttcatctaagccagtcttgacgcgcgtttctttggtgatcgtcacatcgttcatccgcgtcggctttaccttactgccggctgctgtttgtcgcggcacagacttgcttgaactgacggtttcttccactaaggtgttccagccgccgcaatttggacaccggcctagataagtggctgaaatatagccacagttttggcaaacatattgtgtttttgctttcgccatattatcccttcaatagttacgctttatcggttgaaccgaacccgctttgtcgcttggctaggccgccttcatcgccgtctgccaataagaatggcatgaaaataccttgaccgatgcgatcgccttttttaatcacgacatcgcgcgggaaaaaattaagtagctgaataaagatttcgccttcattggctggattgttatagtaatccgcatcaatcacgccaatcccgttcggcaacaccaagccatgcttcaatggactgctcgaacgattcgctagcactaaaacttcattgggctgcatataggctttgatcccagtcggcaccaagtaaggtttcaacaccttcttagcgcgctcaaagtctttattggtcagtgggtgctcatttttaatcaagcggaaaagacggataaagtcgtaccgccaaatacttcttaagacgaagtcctcacgtgcataaaagtcgtaaccagcggcctgcttcgtctgccgggtcggcaaagttaaatcttcatcttgatactttgaaacaatctcaaaacctcgggtcttcatagctgcctccatttaaatagtgtccaaagtatcataccatgcgggcacatggcacggccatggtgaaagggcttccctccttgtaattataccgcgttcctgatagatttggggtagtagacaggttattaaacaggcaaacatgtaagcgtctgaagctgcttaagaatcctctaaaagtttacctgtaccatcacgaattgacccaaggaggtgccccatggaattccaacgagaaccaggtcgtttttttaacacggactgggacggccgcttaatggccgaagtcacttttcaagacattgatgacggtcacgcgtgggcggttgaccatacgtttgttgacgaaagcttgcgcggtcaagggattgccggccagctgattgaaacagtcgtggctgcagcccgcaaggaagacaaaacgattgaaccgctttgttcatacgccgtccatgctttccacaatcaccccgaatatgccgatgtcttgcggccaacaaaagaagcttaatcgtccgccgtaccgacatcatcacagcaacaaaaaaagccgctatgagcggcttttttgtgagcgcaagcagactcccttagaaacctgcaaccgggtaataggcgacaattgtctatgctagccgatcattccagcgattcttcttagttggcaacaggaagtaaatcaataaccagatttgaccgatgattggcacataccaaagcaaaacccaccaaccacggcgatccgtgtcatgcaaacgccgaactgacagcgaccaattggcaataaaaataatgaaattaatcagtgatgcaagaaaggtttcttttccaggctgaaaattcaaaacacgcgtgacgttcatgccaaaaatattaaataaaatcgtcatgatgacatagccaacgataacattaagcaaccacggccaccaaaattcacgccgcgacgccgtgccagaaaagttgcctaaatgcttaaaatagttctgatatgccttaaccataagcttaaacccacctaactagataattgtatgtccaaataatactggacatagtctaaattatacttttagtaagtgcttattaaaagtaaaataccccgaaacttcttattctgagaatctgcagcattttgttgaatagattaacgagcttgtgccactcaatgatccattgattttccatctttaaattcaaattaaaatgaggtaaggtttctttaatgcaataaaaaggagatcgcctatgtcagaaattacatttgatcaaattaaagactttcaagcccaactagccaaacagccggctgccggcgccacagctcgtgcggtgcaaaacgttggcccacaagctgcaagtcgcgaacccattgacggcgaagatatgaaaccggtcttttctcttgatcttgataccggtaccgttgctaaccaaaagaaaagtggccgctgttggctctttgccaccctcaataccgttcgccacggcattgctgatgaattcggcattaaggacttcgagttttcacaaaactacaacgccttctttgatcgtttggaaaaagctaatttattttatgaaaacattttagcaacggccgataaaccgcttgatgaccgcgaagttgccgattatctgagtgacccggatcaggatggcggtcactatgatcaggctgaagcactgatcgaaaaatacggtctagtccctaagtcaatcatgccagaaacctacaacagcgaaaaaacggttgaactcaacagcgttttgaatgagaagctgcgcaaagatgccaaagtcttgcgtgagttgaaacaggccaacgctggcgatgacgccattgccgctaaaaaacgcgaatttctcagcgttgtttaccgcattctcgcttacacttttggcaacccgccaacccaatttgactttgaatatcgcgatgataagaagcagtaccaccgcgacaccaacctgaccccgcagtctttcttcaaaaaatatgtgaagtggcattttgacgattacgttgtggttgcgagtgatccggagccgaacaaaaaatatcatcagttgtataccatcgcttcagcgaacaccgttgtcggcggtcatcccctgaccattctgaatctaccacctgaccagttgaaaaaactggctttaacccagctacaggccggtgaagccgtttggttcggcaatgatgtgctcgctgatatggatcgcaaatctggcacgcttaaaggcgggctgtataactacagtgacttattcgatctggatcttcatttcgacaaaactgatcgaattgtgaccaccgaagcagaaatgtcgcatgctatgacgctgaccggcgctgatgttgttgacggcgaggtcaccaaatggaaagtcgaaaattcttggggcaaagataacggtcacgatggctattttgttgctgatgcatcttggttcgaccaatatgtttatgaagtggtcgttcgcaaagatctgctcgatccagctgatcaagcagcactcaaaacaacgccgatcaatgtacctgtctgggatttcctgaattaaattggacttgtatgctagactaatgatgttcgacaaaggcagtgcacctacatgctagctcatgctttcatgaacgcgcttgtcttcgtcttcataacgcgcttgcagtcgcagaagcctgcacatttgggctcaagcccgcttatgctccggcttctaagcgcttctgctcgcgcttaactttaacgcgctcgccagcccagaaacctgcgtgtaagggccccagatgcaatggccaaaaccgggccatcacatctggcgccgcttacactccggtttctaaccgggctggctcgcgctcacaaaaaaggagtgtcttttaatgtctgcagaaattaccactggcgatctggctcaattcaaacaagatctccaagccacacccggtgcatccgctcttcaaaaagcggtcatgaacaacggtatcaacgcaactgctgagaacaccgacagcaaagttgccatgaccccgactttttctattgaacttgataccggcagcgttgccaaccaaaagcaaagtggccgttgctggatgtttgccgccctcaacacgatgcgtcacggcattcaagcacaatttaaaatcaaagacttcgaactttctcagaattacaccttcttctgggacaaatttgaaaaatccaattatttttatgaaaatgttctaaaaaccgccgatcaaccactcgacagccgtaaagttgcctttttgatgaccacaccacaacaggatggtggtcagtgggatatgttgtctgctttgatcgaaaaatacgggatcgttcctaagtccgtgatgccggaaacttacagctcaagtaaaagtagcgagttgaacggtttgttgaacttaaagttgcgcaaggacgccgttgcgcttcgcaaactggttgctgataaagcaagcgatgctgatattgaagcagctaagcagaaaatgttagctgaagattatcggattttggcttacaccttaggcaacccgccgacgaagttcgacttcgaatatcgcgatgatgataagcagtatcatattgaccgcgaactcaccccgcagaccttcttcaagaagtacgttgcatggaaccttgatgattaccaaagtatcatcaatgcgccaactgacgacaagccatacaaccatttatacacggttgaaatgctcggcaacgttgtcggtggccgcgaagttcggcacttgaacctcgatatcgatactttcaaagccttggccgttaagcagctcaaggcaggcgaatcagtttggttcggttctgatgttggtcagagttctgatcggcaattgggcatcatggataccaacatctataagaaggatgatcttttcaacaccgacttcaccatgaccaaggcggaacgcctcgattacggcgaaagcctcatgactcacgcaatggtcctcaccggcgttgacattgtcgacggcaagccaaccaagtggaaggttgaaaactcttggggcgacaaggtcggtgacaaaggctattttgtggccagtgattcttggtttgacgagttcgtttaccaagttgtcatctccaaaaagtacctgtcagctgacttgcaagacgtcatcaagaacgaatacgacaaaccaaccgttctggccccatgggatccaatgggtgctttagcttccaaataagtccatacgaattggtaagctgtcatattgcaaagcctcacggtcaatgatcgtgaggctttttgctgttcgcaaaccccttgcgaaaccatcaaaaaatgttttgctagttgacgtatcgaacttttttgattaaagaaaaatgtggtattctggtgacacatcgtaaccacgcgttttttgataccggagtcatctcagaaaacgctcactttggagggcaatgtatggggacacaattcgcctttgactggcgccaaatcattcattcacgaaaaaacatggccgtactcgggttgttcatggccgcttttatcgtggcgtttttcgctttaagttggaccaaacggctcgatgtcactcaaacatcacaagcaacagccaacgccgcgttggccaactatgctgaatataatctggatacgttgagtcaagcacaaaaaccattattggctaatcttgacgcccaaaattcagcaaccggcgtcattggcttgggcctgcagcttgatgagcctgacactacccgtaatgggctgcttagtttacgtacggcgcagctagccatgcgccaacatcattacaaagcgctcaacacgatgccgctgccaccgttgcatcagcttactggcgatgtgcggagcctgaacgttttaaaatctgaaggccggcctgctgcaacaagcgttagcacaagtgcttcttatattgttttggtgttaccttatctcggctggatcactggcgccgctgcgatattgctcagttgcgacagttggatcgagcggcggcgacaccggacactcatcactgctcgtcctttgacagctggccttgcggggagcagccgcctactaatgcttaccgggttttacatcttaacgctgcttgccggttttgctttgatggttgcgacaccagccctgatagctggcctaggtgacttcaattatccgatcgccgtcatgggtacagccatactgccattgtggcaatacatacttttgtttggcggcctgacaatcttagccggtatttggctcatcagttttagtatgctagtcaatacttggatcaccaacgtttatctgaccgcctttatcgtcatggcagccggattattgccagtcatgctgccacagctcttccatttcctgtggttcctgccaatgccatatctagacagttacgcgacattaagcggtaccttagtggatcgcttgaaccagccacttgctagcgtcgtcattggcactggtttgctgtttctctggacctttgttaatctctttatctttggcctacgtgtcaaaaaggaggcagcatgatggcttattttcgttttcagttccaccagctgctgaccaaccggaaaaatctagcagtaattggtatcgccttagttgccctgatctgccaatttgtcttttccccaccgaacaccacaccggtcgagttaccgacagcaactgttttaacccgtgatcgcgataaaaatattgcctttgtcaacgaatcgcacgggcctaataccgctgtatgggtgccatcaacacgcgaatttgctaagcttgaaacccagatgttaacagcgcaaaagcaaggaaaaaataaagcttacgttcgcgcaactatcaactatctcggctttttgcgaagatatgctgctaatcccgatgcccaaagcagtccgttccattacccgctcacctattattacgaaaatcgtcaatatcctgatgctgatgctgcttacgctaatgttgttttaacgcaatcactaatacctttggcaaaacaagcacatccagatgtatcgacaattcatcagcaaacattctggcagacacttttccgcggcgcactgggtggctggctgacagcgttgttgctcatcaccattctgcttgcgaatgatctgctgaccagcgagcaacgtcatcgcagtattgcgcgttctttgccgcttagtccgtggcatgccatcaataccaaaacgctgacggtacttggtaccctcgccggggcagtcaccttgctaattggtgtgactgctgtatgtgtcatccccttccatggtcttggttcactaaccacagccatcagtaactttgccaaaaacgggtcttacgcttatgtccagccactggcacttggttctgctttactcatgatgctcggtttgactgtactgctcatgtggctgttcattcgacttaacttgctttgccaattgctctttcacaacgaattgatcggactgtttctcagcgccctactgctctttggcgaaccgctctatttcatgcaaggtctagccttctccgtaccccaaacagcctactatctgcctagttacatgaatccagcagccatcgtcaacggcctacaaaatttcagatacgatactggccaaatgacaccgttatctggggtcatcgtgattggcagtgtcattgtcctgctagaaatcatgctgttcatcgtgacacatcgccgacatgctgcgacggttaaatagagcgtgagctggcgcagttagaaaccagcgtgatgcgtacgcattttacaggagggtacatcatggaattgcaactgcaaaatcttgcattaagttttaaaaacaaacccaacgtcattcacgacatcagcctcaccatgaatggcggatcaatcgtcggaattgtcgcccccaatggtaccggcaaaactaccttgctgcgcttgattctcaatgatctaaaaccacaagcaggcaaagtgctggtagatggtaaaagttatggtagtcaaaaacaaagccttgcgctgcaccggcagatgtgccttttcccagttcaagatgatctttatccagatttatccggcaaagcgcacctcgagtattatgccaagctttggcacaatcgttcgaagagcgtgaaacagattatcaatgtgcttgacatgcgggactacatcaatcaaccggtgcgtacctattcaatgggcatgaaacagcgattatgttttggcatggtcatggcggccaacaccccaatcatgctgttggatgaatttatgaacggacttgacacgatcaatgttgcccgaatgtcccgcattttgcgtggcttacgcgcagaaggcaagctgattatcacggtctcccacttgctgaacaatctgcaagggtacgccgacctcatctacttcatgcgtgacggtaagattatcaaaaccattgaccaacacgaacagcagccgctctatattcaggttgctgaagaaaatgccagccgtttaccacgtatgccgtgggaacattaccccaacggcatgttggtgctgccaatccaaaaattgccaggtgagcatttcaatcaactactgttgggtttagcagcccaccatattcccttcaaacttgggccactcgatcttgatacttatttcaacgaattttacgaaactgattaatgaaataaaaacaacataacgtaactcatgccgctgtttcttattcattagtggccgacaatataactaaatttattattcaggcgaacaaatgctgcaagttcgccttacaatatgtcgtgattctgctacaatgacggtattacttttcaggaggctcaaaaatggcgtcaggcttgactgctaataagaaactgcgacataaaattactgccgcggctttactggtaaccctcggtgtcgtctatggcgatatcgggacgtcaccactatacgtaatgaaatcaatcgttgctggcaacggcggcatggggcattttgatactgactttttggtcggctcagtgtccttgattttctggaccctgctcattatcaccacggttaaatatgtcttgattgcattacgggctgataacaatggtgaaggcgggatatttgcgctgtatacgcttgttcgccagcgtgctcgttggttggtactgcccgccatggttggcggtgctgctctgctggcagatgggatgctgacaccggctgtgaccgtcacaaccgcgattgaaggtttgaagggtgtccatattaacggcaacatcttaatcgacaatcagcaacaggtgatttgggtcaccattttgatcattaccttcctgttcttcattcagcgatttggtaccgatctgattggtaaggcgtttggtccgatcatgtttgtctggtttacattcttaggcgttgctggctttattgccttgtcaaaggactggtccatgttgcgcgccttgaacccttattacgcactccatttactggtcagtccagacaataaaatggggctcttcattcttggcagtattttcctggcaaccaccggtgctgaggcattgtattctgacatgggccatgttggtcgcggtaacatctatctcagctggccatatgtcaatatctgtttggtgctcaactattttggccaagctgtctggctggatcaaaattcaaaagtaacggcgttcaacaagattactgacttcaacccgttctttcagatgttgccagaaagcatccggttaggcgcaattattttagcaaccttggcggcgatcatcgcgtcacaagcattgatttccggctcttatacactggtttccgaagctattaaactgcgcttcttgccacgactgcacatcatttacccaacaaggttaaaggggcagctttatattccagtcgtcaacaccattttatggttggcttgcttagcgatcattggctacttcaaaaccagtgctgaaatggaaggtgcttatggcttggccatcaccattacaatgctgatgaccaccctactgctgtaccaatacctgcgttcgcgtcatgcgcctgctgtgattgcgatcgggacattgatcttctttagtgccattgaaacagtcttcttcatctccagcgcggttaagttcttgcacggtggttatgtcaccgccatgatcgcgtttatcattttggccgtgatgtatgtttggcaatacggtggcagaattcgcgacgacaacacttatcgagccgaaatggcttcgctttttgcctataaaaatcaactgtccgagcttcgcaacgatccagattatccaacatacaccaccaacttggtttacatgacccaaattgcgaatgaccattacatcaaaaaggaaattctctactcaattttggataaacggccaaaacgcgcacgggtttactggtttgttactgtcaatgttacggatgaaccgtatactgccgaatatacaacggatacgtatgggaccgattatatggtcaacgtccaactctatctcggcttccggatggaacaacaggtcaacgtgttcttacggcaaattgtcaatgacatgatgcgtgaaggtgaattacaaacgcaaccgcaaaaatacacaaccattccggatcgacaagttggcgactggacttttgtcttgctgcacgaagagctttcaccgcagacccagatcaaaggtttccagaaggccatcattcaggcacggctacgactccagcacatcgcagtttcacccgcacaatggttcggcttggaatatgcggataccatcgatgaaaccgtgccactggttcttggtaaaattccgattaccaaactcaatcggctaacgcgttcccaagcagaagctcaacccgaagacgaagacgattaagtcgcgttactaaaaagaagctatatcgcgcccagcagaatgctgtgcatcagatatagcttcttttttatccatcaagtcggttttcgttttttgtaaacttgtcatgtggaccagaaaatcgaactttttcgaaactttttactgcaagcggctttatgaaggttgcttcgtctgtttttccgcacgcaacgttgcctgagcagcagcgagacgaacaaccggcacccgatatggcgagcacgaaacgtagctgacgccaatctggttaaagaaggtcacagagtcaggatcgccaccgacttcaccacagacaccaatggtcagctgcggctttgtcgccaggcctttctcgacagccatctgcatgaaggccccaacaccttccgtatcaacggtttggaatggatctgctggtaaaatgcctttactcaaataatccggcaagaacgagccaacatcatcacgggaatagccaaaggtcaactgcgtcaggtcattagtcccaaaactgaagaaatcggcagcattcgcaatcttatcggccgtgatgcaagcacgtggggtttcgatcatagtgccgacttcgtaatcgactttgattccttttgttgcgactaactgctcgatttgatctgtcaccaatttccgaacccagatcaattcagtctcggagttggtcagcggaatcatgatgtgcggggtgaccttcatgccttcgtcggcaagccggaataccgcatgcatcatggcccgaacctgcatctcataaatatctgggaaagtcacagctaatcgatcaccacgatgccccaacattggattgacttccttgagggcagccatccgttcgcgtagctgattttgctccaggccaagatcttgcgcaacttcactgatttctcggctgtcatgtggcaagaactcatgcagcggcggatccaagaggcgaatcgtcactgctttaccattcgcaagccgatatagctcgtaaaaatcctgctcctgcattttttctagcgcttgtagcggcgtcttgcgaccagccgcatctttggccaaaatcaatcggcgcatctgcaacagtcgttctggttggaaaaacatgtgttcagtccgggttaagccgatgccgtcagcaccaaatgccagtgcttgctccaaatccttaggagtatctgcattggtaaacacggccatgcgacttgcatcttttgcccatgtcaataaagtggctaagctttccttgaccatcgccgccgttgtggtgatttgaccacgatacaaattgccagtggtaccgtcaaccgatacccaatcgccttcgtggagaacggttgacccaaccgtagcggttttggcgtgttcatcaacgcttagtgcgtgcatgccgacaaccccagtcgcacccatgccgcgagctacaaccgctgcatgggacgtcatcccaccacgcgccgtcacaattgcctgactgacaatcataccttcaatatcttcaggcgaggtatcttgtcgcatcaaaataacttgatggccggcatcatgcgccgttttggcatcagcggcagtgaagtagacttcaccagaagccgctcctggtgaagctggcaaaccagttgccaaaacagtatgcgcggccagcacttcaggatcaaattccggatgcagcatgtcactgatcgatttaggtgccacccgcagaatagcctcatgctgattgatcagtccttcattaactaaatcaaccgcgattttcaccgccgcggctggcgttcttttcccattacgcgcctgcaacagataaaaatgaccgtgttcgattgtgaactccaaatcctgcatatcacgataatgttgctccagtttcgtagcgatggttgccagttgatcataaactgctggcatttgtgcctgcaaaacggcgaccggctgcggcgtccgcacaccggaaaccacatcctcaccttgtgcattcaatagatattcgccgaacaaggcgcgttcgccagttgccggatcacgtgtaaaggcaaccccagtaccagaatcttcaccagcattcccgaaaaccatggtctgaaggttcaccgcagtcccaagatcttcagggatttgattttcccgacgataaatcacggctctgtggttattccatgactcaaagacggctgcaatcgccgctaacatctgatccttaggcgcctgtgggaacgttttgcctgcctgctcatacagttgcttaaatgatgcaatgattgcctgcaaatcagtcgttgtcagatccaaatctgaagcatagcccttatcacgtttcatggtcgttagaacgtcatcaaacgctttttccgaaagaccgtagaccacattgccgaacatcgcaagcaagcggcgataactgtcatacgcaaatcgcggatcattcgtgagttttgccaaagccacaacggtttgatcattcaagccgatatttaggattgtatccatcatccccggcattgaaatcggcgcgccggaacgaaccgacacgagcaacggggatgtctgatcatcgaactgcttgccagttgcctgctccaaggccgtcaagtgtgtatctaattcttgcaacaaatcatctgagagcccgtgattggtttgatagctgtggcatgcagcggtggtaatcgtgaatcccggcggcaccggcaggccaagattcgtcatttcggccaaattagcacctttgccacctaaaagtgcgcgcatctccatgttgccttcagcaaatgcataaatctgtttcatcataaagtcttcctttcgtttaatgtgacgtgatatatgttcgatttataatgtattatttttgaagacaaaatgcaagcgtttacacctaaaattggcctaattattttttgaatcattaatgacaacaaaaaagccgctcgcaacaatgtacgaacagcttatgggacaagggtttcaatgagatatttaaaaattcggttttttgtaatttttccaatcacatgggtatcaccagcattttggactaccggcagcgaatcaacattgtgtttaaggagcagtttgctggccgcgatgatcgatgtatcagcggtgacggtaatcacattcggcatgcgggtcatgacgatgctcgctggtaacgttgtatcgcgattagtaaagcttgctcgtaacaaatctttacgcgagatgaggccaactaaagcaccatcatcatccaatacgtacaatgaaccaacgtcggctaaaaacagtttggtgacggcttcttccatcgatgtcgtcaatttaatctccgtcggcggcagtaagatagcagcaatagtggtctgaaagaacttttggctatccatttgcagcagattctcgccttgatacgcatagccgactttaggtcgcgcatctaagattccaattgttgtcaacagccgtaaatcagcgcgaattgtcgccaaactaatgttgagcttagtcgccaacgtttcccctgtcatcggactttccgctttcagtagctgaatgattttattttggcgctgggtcagttgcgtgacggccacctcctattcattaatgttaattataacatttttgcgatatatgacgtgatatttcgtcgcgaaaagtttggcaacttatttggagaggctgaatactagcaaaataaagtggctgggtcataattcttagtcagctattaaaaacgaacggttttccgttattggaaaaccgttcgtttttgacttctcatggattatttattgcgattttaaagaccgtagtgccaaggcggagcaatcgtaggccagatggggctcagccgtgcaaacaacacagcgaccgggctttgtcgctgatgttgttaggcgacttcgagaccgcgggctttgcgggctcgaagcgccgtctccgctctagctacgcgtcgccaccccagctggccggagattgcggagtttggcacggcaaaaaagttttagcccagcgactttctacgattattcggaatttaatgaatcacaaatcttgcaagggaattatggctcagcctccataattttataaagtttgcttatccagaatggttagcttgtcatccaaggtgtaaacaatcggttgagcatttccaatttcgaccttgttgatgccagcatcgctgatgtcttccataaacttcaccaaggcgcgcaaagtagagccgtgagcgacaatgagctgatttttcccggacaaaaggcgcggtgccagttcagctgtccaatacggtaacaaccgttgactcgcatcggcaaggctctcgccgcgcgggatgatcgtggctggataacggtggtaccgccgggttcgactaggattagcaagtaatggcggatgtgcggaaaaactccgccgccaacttgcaacctgatccgggccgaacagcttgcgcgtcaagtccttgttaataccacgtaaggcaccgtaatgccgctcattaagccgccaacttttcgtgatcggcaggtagttctggccgatcttatcttgcacgatgtatgccgtcatgattgcccgcgatagcacgctcgtatgaacatgatcaaacaagatccccgtggacgcgattttttccccagctgtctcagcttgtgccttaccctctgcggttaaacccacatccgaccagccggtataagtattcttctgattggcgatgctctcgccatgccttaacaggactaatttaaccacaaaacggcctccttaacccaactagtataccagactgcgcgggcgagtggtaaacgcatcaaatagtgctgctttgcttagtttcatgtttgtcattctacttcattgatgtaaaccagcggaatagcaatggactcaatggtcaaagcgaagcagttttcttcgctttgactaatacctagcggcgagacggcgttggcctttcacattagctcgaaattgtgccccaccactctaaccagctcgggcttccggaacaagctcattcgaagagaactaaaacccgaaccatccccattttctcactgaaccacgcgaacaggcccagaagcctccacataagggcctcccaaagcccagccatttaggcttgaggtcacttacgttccagcttctaactgggccttttcgcgctctgcatttttgccggaaaagctggaaaatgataggctactatatatacgagatcggcgaaggcttgtctctttgcctttagaaagaaggatgctcatgacccagtcgcataaatcggttacgatggtcgagctgttctatgatttaatttttgcctatgccgttggccgtatggcgcaagcgcttgcactgccgacacatggtttcattgctccgcgtatgcttggtgagtttttgatgatgctacttgttttctgggtgatttggacttaccaaactgtcttagccaaccggtactttaacaaccaactagcccaaagtctctttactctttttaatatgttctgggtcatcgtcttgagtaccgccatcaacgttgatttcgttaaaacaaaatggtcctttcaattgagcaccgccattttgtttttgagtgttgcgattcaatatggcctgatctggcggcaaaaacatgctgctttacccaaaatttttggtctgaccttaacaattgctggcgcgctggctcttgtatcgcctttcctaaccccatactcgctgtcattcacggtcttctttttgggcgttgtgggggccagttttgtcccgctgcttttctggcgaacgatcaatgctgccccggtggattttagtcatttgagtgagcgttactcgctactggtcctgctgattttcggagaagcggttattggcgtggccgatacggtttatagcggcttatcactgcaggccggtttgtttttctttgtggttatattgctttttgtggcttatcagctagtttatgataacggccttaaccgccagataaaaacaggcggtttggcagctattcatcttcattacccgttattagcggccatccttagcatcagcacgtttatccacctgtggttgactcaggaattagatccgcgttggtttgccgcggcgattaccttggctttagctgtttactattttagcctgattggctatttgcgcgcctatccaaccaacaagatcgacatcggcttcaagcgttggttttatttagggttttcactcatgatttttggggtatacagcttcatgacggcggctatgccattgccatttatgctaggcttaactgcgtatttgctggccaataccttatatctttggcaattcattctccatcccaacgacccgttgtataatgaaagtgatcaatgaagggagaattcatatgacaacatatgatgtcacattcaacaccgtcgatggcaagtcgctgattaagcgcaacgtggaaagcgaccacgaaaacgcccgggtctgggaggacgcggttgagcgatttgacgccgatcacctctacatcaaaatgaacgacaagacaatggtcagccttttgcggcgtgccgttgttcgtatcgacatgactgaattacctagtgatgtcgaaaaaaaggctaatcgccgagatgaatttcgtaatgccatgtacacattaagtcaaatcgggctgtgacctgattgccgctaagccttgttgccatttcaaatggcagcggggcttttttgatgggatcgttagcagataaagctgactgtgattgcctttaaaagcaattgaaatggcacaaaggcaaaaaatcctccgcaacagcaaagtcgcggaggtcatgattttatatttttaaagcacgcttctggctgaattagtcagcatagttgaagtgtgttaatggtgcgtgcttcacatcagcaatcgtcttagtgccagcaagttgcatgatgatttcaagttcgtgatcgatctgctcgaacacgctttgaacaccttctgcaccacccaaagccaagccatagatcactggccggccaaaggcaactagatcagcaccggctgctaacgctttgaaggcgtgactgccgcgccgaacaccggaatcaaagatgattggaacgcgcttgttaactgcctttgcgatcgctggcaaaacgtcgaaggatgccggcccaccgttcaactgacggccgccatggttggaaacataaatcgcggctgcaccggcaccaattgcgcgcaaagcatcttcaggagactgaacccctttgacgatgactggcagatcggtgtattcggcaattcgacgaacatcgtcttcactgatcttttgagcagcagaggcataaatctcgccaattcctttgcctttaccgtcaccggctgaatacttttccaagttcggcattggaattggaaactggaagttgttaatgatatcttcttcacgataaccatcaacagtggcatcaaccgtcaaaatgatgcccttcacaccggccttcttagcctcatcgagcaagctcttgttgaaatcccaatccttactcatgtacagttggaacaactgcggtgcgccattgccggccgcggctgtatcagcgatggatgttgagctgtaggtactctgagccatcaacccgccaacggctgcaacgccccgcgcagtatctttttcgccttggctatgagccaaaccttgcgcagcagtcggtgccatcataattggcgtcttgagatcaatgcccaagaagttggtggacagatctggagaatcaatgttggacaatgccttaggaacaatctgagcgtgattaaacgcctttgtattttcggccaaggtccactcatcttcagaacccccgacgatataaccataaccgccagtaggaataatcttctttgcttcatctgccaatgacggcaagttcaaaatgttcaatttcttttctgcatcgctttgttcgtaaccattaacaactgtcatgtgtaaaaagcctcccaaaattgcttacttatcagaacacagataagtgtatcacttataattagtaagtaaaggaattttgctaattttttgtaagtgattatagtgcggctttgttcctacaaaaaaagaacgccatctgtcggcgttctctctggtttgaccaatcggagctacatcccccgatttagtcctcttttttcttagtcttatctacaacgtcattgaacttctcggcaactttatcttttgcttcgccaagtttttctttcacgtcgccagcaatctgttgggccttacccttagcttcggttgattcatcaccagttaatttaccagcggtttctttaaccttgccgctaaccttgtcttttgctgcatcataatctgtcatatgatttcctccttctttgcttaatttaaggataccaagttgacattatgccatgccagtttggggctcacgcaacctctaaggaaaataaaaaagtctgtacaatcggcgtacagtccttttcatttcaccctagtgacgtgcacccggtcgtttttcttcaggcgctggcgggataaccgctttgccgccttttttaatatgcttgtagttcacgaccgtcttattcttcatatcttcaaccagtgaggcatcatcaggcgaaaaactgtcgattgtcagcattgccgcgttggcatagagcttttcaaccgtgcctttgaaactcaatggcacatcttttgctttacgaactgatactttatcaccaataacgatttcttgtgacacagaaaaacctccttaaaggcattcgccagcaaattcgccgtgcgggcttaacttgctggcgggtaagtgcttacttggtggcctgcactttcactttgatcggtgcatccaagtcaaccgaatcactgaaatgttgcaacaaatagcgctgcatagcgtcgcgcgcttctcgcttagtcatctgatgacagacccgggaagaatcgtgccgatgcccccatttatccgtatactgaccaacgacttcataatcacgaagatgtgctgcaaataacatgattcctcttgaccacctttattaattgtaccatgagtcggcacacgtttttgtatcacaagaagcatttatacaccctagaggcatcagtttcaactattctaagaaaaaagtttataaactgctattgacaacgctggtggccttgatcttgcggctttttacggcagcactcgatgctgtaatcctcattttagaggccatgcaactaacatcgtcgttagctacccgacactttctttaacttgattttgtgttgttgctaactgcgtcgtttggctgcgtttcatgcgattgaatgcaatgactgtgcgaccaattaaatcctgtacgtttacttgatcctgcggcgcataatcaagaatttcgaccaatgcagaattttcatagcatttctgaatgcgaccaacaaaatcatgttccatattgccattcgcacgacataaaacgaccatgccttcttttgcctgcttcatgattaagttcccccttgttatgtgttgagctaaggttaacaggccgaaagttttatcgtcaacataaatgatcaattatatataaattttcataatttcgtcacaatcccgccaaaaggcagttgaatgcgcttttattttttagctttaattaaaaaaattttcaaaagatttacaagtcgaccgcctctttttactgaaaagtgttgctctcatcgattgaaaagtcgacaccatttgcaaaagacgccctgcttcagtattgacatcttcactgaaaaagccaacgataagaaacaatagactccaaacaaggcgatgattttcgtggataggcacatttttggtgcaactttctcttcactgcggtcaaccaatttccgccgcttctggattggccaatgtatctctgtcatgggcacttggatccaacgaacaacgcaaacatggttggtctatcaaatgaccaaatctgcatttctggttggcttgctcgcagcggctcaatttgttcctatcatggcactcaccttaatcgccggtacgctcattgatcgctaccccaaacgacggattcttttgatgacccaatttggttttctagtcttgggtgctgccatgacgatcatcacttttctaaaaattgttcaatactggcaaattctggtaattgccttaggctatggcattcttcaaagttttgatacgccaactcgacaatcctatgttattgaacttgttggcaaaaaagacctcatgaacggtatttcattgaactcttccattttcaatttggcaaaaattgcgggtccttccctagccggggtgctcatggtcaccataggagtggcgccgtgttttctagttgacaccttgagttacattgccattattattggtttattgatgattcatcagcagcatcctgttgccagtcacacaccgcgccacatcattgctgatgtcaaagaagggcttgcttacatcgtccaccatgacaacgttaaattaagtgccgaattaatgatgattatttgcacactgaactttaacaataatgtcatcatccccatctatgcgcaggaagttttaggccgtggtgcacaaggctatgccaatctgctatcggcaacagggattggttcactgattgcagcgttcctcatgagttatctggctcggtttggcctacgccgcgatttatatcttctagtggcgttagggacggccttggttcaatcgctgatgattcttgttcacgtttattggttggcgatgatttttatggttgtcattggattttgcaacatggttttcttgaatcaatccaatgctgcttttcagttctctatccccaatgagttgcgtggccggatcatgagcgtctacgttctgctcaaccaaggctctacgcccattggcagtttatacgtcggtggtttaatggacatggctggcggcctgtgggggtttccttcctgtggtttgttggcgttgctgttaaccataccgatcctgcttagccatcaaacaacagttaagcattggctccatgcttaggccgtaaaaaatggcgttgacacaaactatctgtgatcgatagattgtaccaacgccattgctattcaaaataaactatcaatttttccggatctgcccattgcccaaaacctgatacttaatcgtggtcagtgcggctaatcccattggcccacgagcatgcaatttttgtgtgctgatgccgatttcggcgccaaaaccaaattcatagccatccgtgaagcgggtcgaggcattcacgtaaaccacggcggcatccacctgctgtaagaactgctgactattttggtaattgtctgtgataatcgcctcactgtgctttgtattatgcgcattgatgtgttgaatggcttcttcttctgagtcaacgaccttaacggccataatcaggtcattgtattccgtatcccagtcttcagcggtagcagcgtgcatactcggcacgatggcgcgggcacgttcatcgccgcgtaattcaacgccatgatcttgcaaggctttagcaatgactggcaactgctcatttgccacatcagcgtgaatcaaaagcttctcggctgcattgcagacagatggccgttgcaccttggcattgacaacaatcgccaccgccatttgcaattgggcatgggcatcaacataaatgtgacaattgccagctccggtttcgatcaccggaaccgttgcctgttcaaccaccgctttaatcaaccctttgccgcctcgcggaatcagcacatcaatgtagccgtttaagtgcatcatctgggtggcaacggcacggctaggatcggtgatcaattgcacggcatcacgcggtaacccttttgctgccagcgcatcttgtaaaactgtcgccaacgcaagattgctgtgtaatgcttccttgccaccgcgtaaaatgaccgcattgccgcttttaaaggtcaaggcagctgcatccaccgtcacatttggccgtgcttcgtaaatcatgccaacaacacccaatggcacgcgtttttgagcaatcgtcaagccggcttcgttcacccacgccctgtccgtttgcgcagtcggatcatccagtgtggcaacctgtcgtaccccagctgccatgtcggcaatgcgtgccttcgttaacgcgagccgatcaacaaacttttccggcaaggcgctcgcagctgcaagatcagccttatttgccgccaagatggtatcggcatgcgtctccagcgcagccgccatcgctaacaagccggtatttttctgtagtgtcgtcaattggccaagcgtcatcgccgcggttttggctgcccgccccatctgttcaagatcaattgtcgttgcgtccatatcatcggtctccttttttagtgcacgcgagcaagcttctgcgtctgccaacgtgatatgagccgtttaaaagtgctactaaaacctactattgaaaactttgactgacacttgctgcttgtttgggctgaccgaaccaagtaccgactgggtcgccggccaagatttgtaaaacaatccgcggatcacgaccactagcaagcaccatttgtttgccagcacgcatcatcgtcttggcggccttcagttttgtcaccatgccgccggtcccgaagcgcgtcgaactgccgcctgcagctgccagcactttggcagatagctgcgtaatcgtcggcatgagcgcagcatccggatggcgattcgggtcacggtcatacaacccgtcaatatctgaaaggacgaccaacaaatcagcgccaatttgcttagccactaacgccgacaattggtcattatcaccaaatgtcgtgcgatgatccaactcgtcaaccgctacactgtcattttcgttgatcaccggaatcacttgctgagccaataacgcatcaatcgtgtccagcacatgctgacgattcatcggataatcaaatacatcatgtgttagcagcaattggccaattttcgcaccataatcactaaaccgctgcgtgtacaaggtcatcaattccgactggccaatcgcggcaagcgcttgttgctcggcaatgacagctggtcgtttcgacatgcctagttccgccattcccacgccaattgcgccagaggtgactaacaccagctcatagccttgattattcagcgccgttaaagcgtaggccagtcgatcaatggtttgcaaattgactttaccatttggatgaatcaggctactcgtgccaatcttcactactaatcgtttacattgcatcgcccgttttgccattgctacctccgctgaatgcatacttgtcgagaaatctaatctatcaaaaaaagcaccgccttgatcgagacacccgttaaggcggtaccattctcgttcaaagcaatgctttgcgcttttatcgttatttaagttttgtgagactcatcatacaagcttggattcgcgcacatttcaggactttcagcgattgtcctgatctctgtgaggcgctactatgacttgatgaagtgaattgtatgcgggcaatgacgaaaagtcaagcgcaggtattccgaagcgttgattaccgcttatacgcacgcctcatcgttactcaactccgagcaaataattgtctaaggtgtgcccctagaagaaccaagaacccactgagactgccacaaactaagataaactgaaaaggttggctaacccctttaaagaaaagcaggtagcaagccaccacgataaaactcacggttaaaagcaacgcatttgtcattttgttttgtttctttttcgcgcgcatcaatcatacctccaagaactgcaaaagtttttaaaacgatacaatgctttcaaaaacattgtatcgtacaaggaagcatctaagcgggttcaaaaataaacgttgtattttcgccgataatcgtgtgtcactgctatctcaacaaccgaaattcagcggggattaaaaactcttttccgcatcaagccagccaaccatttactgaaataagggcgaaaaatataaactaggcataggcagtgtcaaaaatcgctcactgccgcgtcaccgccacccgaaaagcgtaaattctaggcagttcctctcctgtatgaatggcctgaccattagccgtgatgccagtgcgcttcacgtgaatcttgacaggcagcggcattttggtcgcatatggtcgcggcaaaagtaggcgctcactgtaaaaagtcccaactggtaggttcttggcgatggcaacaataccgtgccgatctgcttttaccttataggcttctttagaagttaatggattcccaactgaccgccaatgaccatccgttgttcgatagcggcggcggcctgaactgtcgaatcgataaaaagcaaagatgccgccagcaagtggttgctgcgtgccttccggaaagacggctagttgttgaaagagtggtctaaccttcttggcctcataaactgcggcaacatgattggcttttaatggcgtcggctcactttccgctgagccgcttggcatgcccaacatcaccagcagcatgccaagcgccgccagtccttttatcccatattgacgcatccccacacccccaaaataagtcaattaatattgtaataataactttatcattttggtcaaacgatgtgcgaacaaaacaggtgttattaaaattgctagtttctgagacaaacaaaaagcagtttccgcaatcaccttctgattgcaaaacctgcttttggcttctctcttactgtcaagccacgcaattactggacttggccttttttaaccaacactggcaaaataatgacccgatccatgtaactcggacgatgcatgaaggagcctgcttcacgataggctttggcaccactttcaaagatcatcgaaatgtgcttctcagaaggatcaaggctgatttcttcaaccgagtttgggacattaataattttagaccctgactttggtgcggtgaagtctagtttggtccagcttttattgcccggaacccgaatccagattttgcctggtgcgctgccatttgactgactgagcaacgtcagcccacttttggcaatggcaatgccttgaagccgatcccagccattgttatacgaattaatgactttcttttgaatcagcgatttaaagaccatgttaacttcttgatcgagtgttttgccggcaaactttggtgcaagttccaaagcccatgctttcatttgcttcatcgtgatgggtgctggcagcccatttgcattgagcggtaaggcaaggatcgaacggttctttttgttctgaccatatttaacaaaaaccaattgattgttatacagggcaattgctgaggtccgtcttgccaaatgaagttcaatccgggttgactttatcggttgttgcgttgctttagccgaataggcattgatttcgcgctgtgacacataactgataccagcacctgttgtctgcgcggcatcatcagaccaaagcagccgctgatggtcgatgtcgtaagtgataccaccaacgtgcgatttactccttaaaattaaagttttattgtacttagcattatgcttgttcacctgaacaatgattgaattcagtttgtgattaccatcatacaagctcatatagatcgcatctttggactgggtgaccccctgaggcacccagttattgccaaaacccgcttttttggttttagcattgatcgaccaagcaccgcgaagtccaggaatcaccactaatttggcatcggtggccgcgcgtttttcaagcggatctgattgcccgatagctttaatttgcttaattgccgcgcttttggactgcaacggccgcggatcagcttcccattttttaacatcacttggctgatcaactaactggctgtactgataatgatcaatcaacgcccagccgccaaagccaagtgcaacgataccgatgactgacaataccgtcacccaaacccattttttcaacatgcatacactccttcatatcagaattataatatatttgaattaaccacgcgattatattacccggtaattgccagaaaaaaagtaaaaggcggccttgatcgttcttgaaaaaccgtatcacttttttgtcgaatgctacttcaggaataacttttggccatgtcacggaaaacaggtcaggacatctttctcagtcggcaaaataaaagcgaacaaatttctacttaaaggaaatttgttcgcttttgcctgctcataggttatttattatgattttaaagaccggagtgccaaggcggagcaatcgtaggccagatggggctcagccgtgcaaacaacacagcgaccggtctttgtcgctgatgttgttaggcgacttcgagaccgcgggctttgcgggctcaaagcgccgtctccgctctagctacgcgtcgccaccccagctggccggagattgcggagtttggcacggcaaggaaattttagccaagcatctccctgcgattattcggagtttaatgaatcacgagtcctacgttggaattatggtacaccctctttttcacaaaattggtcaatcgaacttgtcttcctgaccttttatgacctacgctgtcggcgcaagtaacggcgggctaaccagacgatcagcacagctagcaacagcacaccgccgataattgcagcgcttttccaaaagcgccattggtcagcagcttttgctgcttgtcccaacgattccgtatagggcacgcgtttaccagtgaccaacaagcgatgcgagttgatcatgtatggcgtgcacgtcatgagcgttgctaaatcctgagctgattcaatctgcaagctttcagtctgatctggtttcacagtttgaatgcgaaagaccttgtatgctagtttcttgccgttaacttcaatcagaaactgctgacctttcttgagcttcttcaaccccgtaaagtagcgcttggttggcaagccgccatgggccgagatcactgtgtgcgtatttttaccgccgcgcggataactagtgccgggtaaaactacggcgccttgatcgagtaaggtgttgttggtggtatcaaatagtggcaagtcgacttctattttcggaatcgcaattcgcccaattaaatgctttttaacataagcctgcttgactttttgctcactgttaaaggggtcttggccgggtcgcaggccggtttcggcgagcgcgcgattctcagaagcgcgttgtgcatcttgggctgcggcatttttggctgcttcgcgatcggcttcagcacgacgactggtcatgatgacttcattgatcgccgtcgccgcaaaagggtagcagaagcaggcagctcccgcggtgaagaggatgatcacgagccagcgcaacagccggttcgaccctttcgcctgcttagccataggcgatcaggctttcttgccagtttgcttcttcacatagtaaccaccgctcatcaagacgatgccgatcagcagaaatgcgagcagtcccatcccgccggtcatcggcagcaatgtgcgtacgggggtgtttgtgatgcgaacgattttctcgccccacgtacctgcaacaatctcaaagtccgtggttggatccgtgatttcatagccatcaggggcatctgtttcaatcaaggtataagtccctggcagcatcccttgaatcgacaggttaaatggctttcctgcgctagtggtcagttcggttgcatcagctttcgttgtcgtccaagtgatcttgcttggggcataagcgcctgtcataccggtgacaccttcaagcacagcatattctgttgcattgccagtttgtcgctgaatgatgaactttgcaccagccaacgacttgtcatcggaaccagtttcatatttgaagaacttcatcccgccagtctgaatttccgggccgttaacagtgattttggtatcgggatcaaaagagacaactgctgtgtttccgattttttgatcaggtaccatcttctcgttcacgatccccgtatagccaacggtcacccgtttaccggcatacttcgtcaacaaattacgaacggcattggcgtctgatccgcctaagaaatctaatttgaagccgaatggatagttgccatgcgcggtttgccatgccgcgtcatttgaggtcatcagcgcgattttgcctgttaagtcgttcaaaatattctgaccgtccacagtcactgcggttagttctttaaacgtcaagccggctttggtcatgtaatccagcacttcaaattgattgtacttgaacacgccggattgattatccgccattgcgccaatgtcatggggaatctgaaattggatattgtaagtcaacacatcaccgacagcaacgtcatgtaagtctttagcggcaactgctccgccattgatagcatctaagtgtttggtaaccacactatccttagggtaaagatggatattggttaagtcattgccattcttgtcacgcaccggcagactcacgatcatatcagctgctttttgatagggctgaggcgtccatgtttcactaaaagcataaacgctgtgccgaccaccggttttagctggcagttgattaaaaactgccaacccatcttgacccgtcgtgatttctggcgcatttggatcttgaagatttgcatagttgcccagattctgcgacatcatcgccgccgcagtctctttatcgtgtgtctctaatagctgataaaaagcatctgtaacattaaacactttgaattttgcaccgacaactggggttctgccagtgagacctaaatcatggccagtgttttgaatctgttcatctgcagtttgttcaattttgtgaagggtaaatgcaacctggctttcggcagcgtgaacggttctgccagcgcccaatagcggtagtaacacgctcatgagcatcaaagcggctaataggccgtgtccgatcttttttatcgtggcattcatgggtggttcctcgctttcttatgcttgatcaggaagtaagttgccaatgtcaggagtcctataccgatgagaacaagacttaggttttgccagtcagacattgccggcaaatatccagttacgcctgcgccagtcggtttgtctgactgatcagactggcctgtcggcgttgtcgggtcggattcgcttgaagtgctgctgcgatctgtatagttataaactcggggattaccgatactgatcatttccggtgtcacgatcccgccgatgttttctttcatcggctggccgtcaatcagtacataacggtaattgtcatcatcatctaaccaagagtcgggaatttcgattttaatcgcccgacttttttcgtccaattcataacctggtactgactgtaattcttcaaaataatacgtgcccgccgacaagaatcgttcacctgtgttcactaaaccgtctttgtccgaaacaaatttattcacacgatcatcatgaagagcatcggttgatgcaacccatttgttcttcaagtcagtagctggtgacaagtcgagatatagtttctgaccgtccacgattcggtagatcgcgaaaatggccccggctaatcgccgactcgtcccgtcaggatgaacgccgaatttaaagaagtacgggtcccggacataaccgacgttcttgggataaagatgcacggtcgacattgggtcacctgaagtcggatcttttaccggaaaaataatcagcatcggtgagctttttctttccatgtcaacgttcagatcggtggagaaatccaacgcggtttcaatcagcagatacgctttctcgaagctgccttgaccagtgtcaactgtgacgcgtccaatcccgtcttcaccaagatttttatcggtggcggtgttaatcaagccaagtcctttattcccttgacctgcaagttgcaggtttgcccgcgcaaacttaagtgcctgcttgcgggtcatattttgatacttttcgatcagtgcctgaacgtcatccggtgtcatatctgacttcaacaaggaactagcatcgtaaacctcaaaattagcgccattcagaccactagttttgctcaacagtttatatccagccttgtcggggtttcccggatcaattatctgaccgtcattgtcgtaccaaacgtcttcaggttgccgcacatcccggtaaatgcgtttatgcaagacaatttcggcagtgttttcagccgcgctgactggctgaagaccaagcagcgtgccaactaataggaggagtgggataacccaccatagcaatcgtagtcgcatcttaacgcgcctcctttcgcttgagcacaatggctagcagtaatccgctagtgccggccactaatgccatcagcagaaatagcacaatgccattgccgcctgttttcggtaacaaactttcaaggctgtgattgacgactgtaaagctaatgcgattaaccttgtcggtggcgtccggcttgaatttaaactcataatcatcagtcgtgagatcactgccgctgtattttaaatcaaccatggtgccggtttgattgatcttaaatgtgaatacccccgccaatttatcgaaaccctcaggtgctttggtttcaactaaccggtagttgccaggagttagctgatgatcaaaaagcaaccgcccttcatcatttgtgttgtccgaagcaaccggctcagtctgaccatcgcgatacagtgcaaacgtagccttggctaatggtttgttacttttattgaccttgagtaactcaagttcagttggtttcaactgattaaccaccgtgttgtcgtcccaaatctccccttgccgtccaatcgtcacgtcaccattttcagcgacaattaagtcaaactctgattggagcaagtgtcctggtgacatcacttcggcaacggtgtactttccggggcgtaaaccggtgaaggtcgcctgtccttgggcattggtgaccgcttcctgcaatggctggccagcttgtttcaacgtaaacttagttccttcaagtaaagcgccatgctgattctttttagtgatgctggcgggaaaacgattcagcgggtctaaatgcacatccacctcgttagtttccttgctatagcgctctttcgtatcgaagaatttcaccaccgcgctgttggtcattgtcacgcgttgatcgatggtgtcaggatcgagggttggccgaaccttgagtcgcagtgagaaatagccgctgtggaagtagattttctgcacatctgctcggccaatcgtcagtgtgatgcgctggcgcccgtcttcttcagtcacctcaaatgatgaaacgccagatgtcaaactcatcgcgcgatctttatctggtgcgtcaggatcagtcgcgttaaaaagttgaaaggcttgttcataagtcggtggcccattgttctgatccggaatcaattcaatattttccggcaataaatccgtcaccgtgatggtcgtcggctttaccacataatcgcccatgctgtaaacttcttggttgatgtagtagtaaaaagggtcgccttggtaatgctcattgaccacctgattgtggagatcgtttgacgtccaaattggcttgtttttatccgccttggcgccaccgccagcaatcgcttgtgcgctgacactcttgttgttggtgacattcgggtcaattaattcaatctgtccgctgccattggcgacccatgtacttccaccgctcgaaaaggttcctcgcttaaacgtgtgactcgtaccattcagcgtataagccacagccccgcggccaaatgttggcgcaccgaggcggtcctcccactcacttagattgtcatgatcaatcggatcaacccagttcccccatgttttcgaggtatagcctttctgaccagtgccccgttcgccaagattctcttgatcaaaaacgtccttgttcgcagtaatccagttaccttcttgaaactgccagtcagtgacataatcagcattgtaagtcgcgttgatatctgactgctcagtccaaacgaactcgcctgggttcaatgatgtaaaggttaaagtcgaattctgattcagatcactttgcggaataaaattcagccgcttgccggtttctttttcataaaagaccacccgccagtcatagtggaggacgttagcgaaggacatcccagaaaagaaattgttcgagaagtcgatgccgacatctgttggcgttggtgcccattcaacgcggcgcacatggatattggtcatttccacataggccccgatctcaaagtgtcgaccattcaaatcgctggccgaacctacatgattgatatcgactttaagcttggcatccaaaacattagacaagccatcttcttgggtaatcacgtctttaaaaatgaccgctgttgctgaagaactcggcacataatctgtcgagacattttctttcatggcagtttggctaccgtatttactgcggctgctaccgtttggctttcggtaaatctgagccgacccaatcggaaagtcagaaccatctgccttcgtgacctgaattttggtttcacccaacgctgcgcgcggcaggatgagactgtgtgcatccaagctgtctgtgccgggttcgctcacatgatcgttcacgatcggacctggcaacttcagatctagattcagcgataccacgtgatcagtgccattgaacccgtctagactgagcttgaagcttttttgcttttgttcctcactcgagagcttcttcgtcatctcatattcatattcagcccagttattgttttcaaacacatgatttatttcaccattcgtatgagcgggttgtgacactatatctttaaatggcgtcacaacaactttttgtgttctattctcactccacggcttgacgagttttagcttcaccttgatttcagcctgctgcatgtcgtatgtgtaagtcacgacatgctggccgaccgccgctgtccattgcccgccatcgtccaaaacaacatcttgtcgatcaaggcggttggtcaactccggcatctccgttttgacggtttggttctcagaactgctcattgctgcacttgtctgtttcttgtcagactcaattgtgtcttggctaattgccgcttgtccgctcgcatcgttctggtgtgaggatggatcggattttggcgccgcacggtcatgttcggtgatgtttgtctcaccgttgtcggctacagggacaacggcgctgccgacctgggtcagcatcaacatcgccaacatgacgatatggatcaacttcttaggcatttgtgcgcctccttccattgtttccggcgtctctcttcttccaacaccagcttaacaagttgaccccgcgcaaaggaatgataatgttcgttatttaacaagatatttttaacattgcatacttattgacattataggtattaatctgtacatataatgtaaaaagctctatttataggtaaataaggtcttaaaacccaaaagcagccttgaaacagccggcgtattgccagtgagcttcaagactacttataggttatttattcaactaattagtttaagctttgatgattttcccaactgcaattggtaaagtaacgtgggcatcgtagttcatgacagttccttgaacagtagccggtagcttcaaggtatccggcacaccatgaatataaatgacccttttatcgagctgcaaatcgtcactgccgaaagcggctttaaacgctgtctgcaattccttcagatcaacgagtttgtcataagcatagtgaccttctgcatcagccactgggtaactgtcatttgtcacatgcatcttagccggttcagcgtcaaatggcaccatcgttgtaccggaaaccggttctgtttctggcagatcaacgaaaccgtcaccattagcatcttgtgccgctgtggcgatttctgcaggcttgccatccgcgaatccgtggaaatgttcccaatgctgcacattagcaggtgtatcaaacatatcgatatgaatcttcatttgcgcaccatcaatcgtgaacgtcgcggcaccgtgcgctgcgctgccaatcttctcagcgttcaatggcacaatttctgctgtatacttttcagccatgcaaaccactccttttagatttagactcagtttcagcatagtgctaactggaacgactcacaatctattgcatttcaaaagtgaggttgcaagattatttggccaattgcaataaccgttggcgcaaagcaggatcagctgcgtaaagataaagcccgtgcttcgccctcttcagcagaatattaatggcattcatgataatcgcggctttagcgtcggtggtgtcggccaaatccgggcgctttttgaatgcttccttgtcttggtactgcgccagatcaaccgtaagtcggtcttttgagggatcatagcctagactcggccctagaatcacacctgcgtaattcaagtcaaagccttgaatagtataaatggaaccaacttcatgcaatgtctcaggacgttgtgcccacgggcgatcggtgaagttgatcttgtcccaaggtaaccgcaaagaaccagcttggacataccaggttttaccatcgagcactgtgaatggatagtcagctgtcgcgatcatgcgcgaaaggccggtttcggcattgcgccgctgaatgaggtcatacatcggctgaccatcagaaaagacttgaaaatcaaaatgttgcggatgtggcaaaggcaacacttttccacgaacaaaatgatcaatccagtcattcaccgccgcatcgcctacccgcatctgttcggtcagatgataatgtgtcactgcgtattcgcgcgtcactcttttcaataaagcaggtgtccaaaaactctttagcttgactagctgatggaaatcgaacacgagcaccaccactcgagccaactgaagaatttcagcaagctgattatgcccacggaatttattatacggatcaggcgtcgtcagtagtaaatggccttcatcgatcagcacgacatctgcccgcttaccggctttgcggtacgcgttaataaatggtgttggtttcataaagtctttctttcgaaaataagactttgtaccagcaatttctttgtaaatcttcagcatttcattgtgatttaccaacaacttgttgtctgtgccagccaactcgccgcttgtcgcacgggcagctttttgcaactgcgcaaaagcagcatccaacaccacacttttaccagcaccggcatcacccgaaatgatcaatagatgtgttgacgttgtgttgtgattgtcgttgataaaggtccaaattcgctgttccaatgctgactgttctgaggtcagtgtcgcattttgcggcaaaataaatgttgactgtgctaaatctggcatacgaacacctccgttaacaacaatacagcattctggcgtgcaaacgctgctgtgacttgattttgtcggtacttttaaaacattttaaaaaagaacattaaatatacacaacaattaacagcatattacatactttaacccagtaaaccggttacactagagatagtcaatttctcgaaaaagttattcaagaactaggagtattgaaatgccttcaattgctgattaccctcaacgccatagcttggcgtcatttcaacaaacaccgctcaccgaacttgatgcgggtttgtttgcgcaacttggttatttgaacttcaattacctgattggccagccatatgcgcgttttgccgatttaaatgacagtacccgcctaaacagggccaccttgactacttgggcgattccaactcatcagatcatgttagacgccatgcgtcacagtgaacgttttgcccgggttacttgggaaaactggctagaaacttgcagccatcgcaacgaagaagacttcgcggccatcacattcacattagcacccggggtttattgtgtcagttttcgggggacaaccaataaactggttggttggaaagaagatctcaatatgagcttcatgccaacgattccagcgcagcgtcgggcattaagttacttgattaaacaaatcagtcagcatcccggcacttattacctgactggccattccaaaggcggcagtatcgccacctatgcgtttgaccacttgccacaaccattagccagtcaagttgcccatgtctatagcttcgatgggccgagcggtgtcccgcttgatccaagccatcgtgaccgtgtcaccaagctcgttccacaaagctccttaattggcgtcagtctcgatccagcgatgaattttgaggttgtcaaaagtcgcgtgaagttgttcggccaacacgatgttcttacttggaacattgccgacacgaccttcgctcatttgccaaccacaacatgggcatcgcgctatttccaaaaaacttttgccctttggttagctggccttgatgccaaagccactgcggttaccgtggacgcactttaccgcattttgcgcagcggcaatgccatcaccttagatgatctagctaaaacaaaaaatcattggcgccactatcttggggctttccggcgcctcgataaacatcatcggcaacaacttggccgctcattccgctgcctcctcggtgccatggctggctcgctggttcaaacgcattaagagggtcacaagctcggcagatgccgggcttttttattacacccatggtcgtgaaagctggccaaaagctaccccacattttagcaagtattcaacttatcctgcgcactagtgtcaacaatcatccatcagcaatgtgcatcaaaatcgcgtcatatcaatgactctatgattctcagacctctatcaattgaaaaaagcttgtgtaattttattcctgcctcaacaataatagcaggtggtgaaggacatgcaattcagcgacaaactcaaactggctcgccaacagcaacaactcacacaaacacaaattgccgagcaattacacgtttccccaaaaacaatttccagctgggaaaatgcgcgcagttttcctgacatcggcacactcgtcaggattagcgatttttatgatatttctttggatcaactattacgggaggatcagacgatgacagatcattacgacgcgattgacaaacatgcacaacgggatcaaaagtattttcaagttacctattatttgaatgttacccttttcttagtcctctggggactgcaagctgtttcaaacaacttcaggtctgttgtcggttggctcacactcgcatttgtgattaacttgatcgtacttgcgactcactacccagactatcatgcatggattaacggtttgcctcatcgcatattgcttttacttctcattataggagtgagcaccattttctttctcattaacggaaagatcgctaatctccagcaaactaatgccgcttatttaaccggtttttacattggcagcgttgcgaagccactcatggaaacagccggggtcatcttcatgatttttggctatggtgagctaaaagaaactaagtaacccaccagctcaggctgatacgcccaattagtcagcatatgttgctgacttttttcttaaatgtgtatcttgctttacaaggtactcactcacgattatactatgcttaacaaggtaccaaaaggaggttaagccatgcaaccttcatcgcaaatgttaaaaggcattctcgaaggcgccattttacagatcatccaacaaggcgatatttatggctacggattacacgaacagttaggtgcgctgggctttggcgatattcctgaaggtaccatttacccgttgctactgaaactgcaaaaaaataaatcaattgtgggcgtccggcgagcatcggaaagcggaccggatcgaaaatactatcacttaaccgaggctggccaacaaacgctggctgattttcaacaacaatggcaccaactgagtcaagcgatggctaagctcaaccaaggaggcacaacatgaaaaagttgaaccaaatgcgtatggccaacgatcaacaactcaaacaaattcacggcacagattacgcttataccgaaacggtggttatctatctgcgtggtgcgcttcgcaagaatccatatgcggttgagcatgcgattagcgatttgttgacaaccttgattgatgctcaaacagcaggacgcaaagtctcaaccttctttggcgatgatcctgaaacagcagcagataatattttaaaagaattgccgcctgccccgcttgattattttgtcagcctattctggccttttgccatgtttccgctgattgacggcatcttgatgatggtggtcgatcacgaaacccgcctcttactaaccgactttttccccatattgatcgtttcgttaggcctctttggcatttcatttggtcgaggtatctcgtttaatcggctttctcgtaaaacaatccgttgtgtcttgatcagcctattcctcatcgttggcttgcctctactaattggctatgtgtcaaatcatgttttcaacctatcgttttctagcaccacactgattcccatctgtggcggctttgtctttctgaatttagggcttgcggcctgctttcggaaaaacgctttattattccttgggtggtcagcaatctgggctttcacggcggcgacgcttttcttgccaatctcggaattatccgttggcttggcctttgttggcctaggcgcctgtttgctgctgcttttctaccgtcctgagtcacagtcacatctggaagtatcctgacctgacgatccttatcacgacaacggtgccaaatgctttatggaggctactcatgaaaaagttaaaacaactccgaactgcaaacgatcaacaactaaaagccattcacggcactgactatacttacaccgaaaccgtcatcggctatttgcggactgatttacgcaaagatccgtacgctattgaacaagctatcaatgacctactaacgacattgaccgatgcacaaacagccggccatcgcgtggctgcattctttagtgacgatccgcagaccgcggcggacaatattttgaaggaattgccgcgtgtgcctgcctggtatctctttgatcaatactggccgattgtcatgtttctatttgcatccatcattttcacgatgctagttggccaagagcatcgactttcattaagcagtatcgcggcacctgttgctgtcgtgtttgctttcattggcgttccctttgcccgcggcatttcattcaacaaagtctcttctaaaaccattttcggccttctaatcgcctttgctctttttatcatcgtccctttgctaatcggctatttttcggctaaaacaaatgccttttcgttttcccgcccactcctcattagcctttgtgttggcatcgggctggtcaacttatgtctggctggctactttcgcaccattgctttactcctaattagttggactggcatctggctgctcgccttgctcggtttcctcttaccagcatccagtttaacggtcggcctagcaatcgctggtgtcctgtgcgcaacagtactgcttttctatcatcctgagccaaaatccgtgattgcggcaaattaaaaaagcccttgcttgtacaaaagcccttctgtaggtagtcaagttcatctaaaaatctgagtcaatccccagtctcgatcgtccattggcccaatcttcatataaagtttgttcagtgcgtcaggtgcatccaactgatgcaaggccacgtagcgtgaaatgctgttcttcaacttcacagcaaccatctgatagggatcaccattttgcagatgttgcgctgatgtgaacaacaactttcgaagatcatcctgtttggcaatctcaggatctgcataagcaacatcgattgcttcaaacaattgtgtttcttgttttttcatggacgtgtcctccttacaaatattcaaagccaaacgctcaacccgccacctccgcgcgctcgcatactagcgcctgctaccaatttataaactggctcaagtgcagacggatactgaaagtgatgaacctgcgaataagacgcgatgaagctgtcaaggcgggcagcgacgtaactgaaccgatcaccacttgccaatcgctgggctgattcaaataaaaaacgtttaatctcatcatccgactgaactgcggcatcattataggcaccatcaatggcctgaaataaccgtgtttcctttccacccaatacgatcagctcctaacgataacggcagtttaacacttcaaaaaatgcggcgcaatgttgatacggatgaccgatcagccaccaaccaccgacatgccaaacataacggctggtttttaatttttcaaattgtcatgtgaactgaaccatgattgactgctgttaccgcccccaaaacactggatagctattgttagtaaccataccgaatattcgccagggccatcaatgcatcaagcttatccgactcggaagcagttaacacaatctggttgtttttcagagcgctggaaatgtcgagattcatgcggctcagaatgaacggaacagctgattcctcctttctaaacgcctctatataatcacttaacacttgttgtaacggcattttctgctggctatgatttaggtctgccaccagttcagttaaaatactgatcgcttgttctgctcggtcttgaccgccagcataccattttaaaatactcattcttccttcacctcttaaaagtctttcggaacacaaaaaggcccatttcgcgccatggtaccacgtgaaatgggccttttgtgtccaaccaaatgatgctctcaatcacttttccgccatcgcgaatccatgatcaagcgagccgtaaacagtcccaatggtaaaaacatgataatcaaagcggcgcgggtcatccattcagcgccaacgccgatattatttaagccgatgttataaatcgctcgataaatatacaagccaggcaccatgatcacaatggatggcactgtgagcgagatccgtgggtagccgtcaattcgattgatcgccgaagcaagtaaccccgcgaccaatgcgccaataaaagcggcagccgccggtggaatcgtgctcaagtcgaccagttcaagtcgcagcgtattcgccactgccccaatcaaaccagcttgtaccgccatgcgctttggactgttaaacataaccgagaaaccaaagacgccgctgaaactggcaatcaaccgaaaaagcagcaaaagcatcggattcaatcccagatcaacaaagttttcagggcgcaagtgcacaatcatcgcgactaaccaaccgaccagtgatgcgacaatcgtaatcatcaaggcatacagcaggcgctccatccctgaccgcatatcttgcttcgaaatatctaacatactcgtgatgaacggaaaaccgggaatcacgaacagcatggcaccaatataaccggcctcatgccgcgcagcgatgcccagactcatttctaatccacgaaaaacaaggaagtacgctaagcaagcaacagcaacactgacgccaatgcaggccaacaaggtccagctgcggcgaatcataataccacgcaaccaattgccgatacccgcgccaacaaaacagcaaaccatctcaactggaccaccgccaagcagaaaaacgaaagcgcaacacgccagcgccgcagccaatcctgctcgcagcggatcataattacccgacattttctggatctgatcgagccgatgatgaatctcgcgcaccgtttccgtggtatattgcttttcaaaattgcgcacaaaccgttcaagtgcatcaagtttatctgtgttcacgccgctttgcgataatgagagaacttcggagtaggcgtggttgttactaaaacaagtgtaggataacgaaatgaggccaatatcagcagaacacgacattcgcaaagcacgcgcaaccgtgttcatagcttcacgcacgcgccatgccccagttccacacgccagcaacataatccccacccgaccaacgagtgaagcacgttcctcaagcgtggcatgatctgcctgccgttcttcgctgacaatcacgtcataccatggaatctgcatgtgatgtttttctgaaagtggccgcgttcctcgcgctgtctgattactttttgccgtcataacttgtgccgatccttcttcttataggaatgtgttatcttgaaaaaatgaaaataaacattcactattttagcacatctgacgtacacgcattggcgatcaaaccaggcctcgtctcttaccccgacagtttacgctgaaatacggcactcaaatgacactttttaaagcagctaacacagcagctacgagataacaaatgatatgcccatcattcaaaacttaacctccttcgtctatgccactagccgcaaaaatgggtcgggtgcctctaggctagttttgattaaatcaccaacgcgtcgtcaaaccctagctttctgttctttaattagacgcagttcacgcctcaattgacgcaagttgcctagccacaaaaatgaaaaatccagttcaccattttcatcagcaaataccatataaggattttccggatcaattaattggctcatggctttgcttgataactgcaatccttgattcagggtcttaatctcgtgaatcaggtgtctgcgaagtattcttttccaaaagaccggcaccgcgtaacaaatgacaccgcccatcaccatcaagctcaccatacctgcatcgaccaaagcgtctatcttcaacaccccaaacttgtgatcctgctgccgatcaaacgatcgacacgctaagcgacaaccagtgtgtttccaatgtttttagttacagccaaacaaatgggcaaaaaagcgttgtatgccacgcctttccggttctggcttgccaagtggttccccgttcgccaaccgtcgaatgtcatcaatcgcatcccgccccaattgactcaactggatactttgtgttgacaaaatgaaatcaattttttgggcaaatctaaacaattggcgatcaaactccggtccatgcggcagttcattgtccatatcaccggcgactctatcaacgacatacgccatctccggcgaccgattaagcggatgcaactgatgaatttcatgacggagaatcataatcaatttcctagcttccatttcaagttgatattccatacccctttacctttcccttaacaaaagataattcccatcccaactttaacaagcacttgcttattgtaagattaccatctcccgcgttgtgtgacgcaatctgtcgattaacgtcgtgttttggccgattaacgtcgtatttttcatctttcagctaaaaaggagccttggttttactggtgattaaacattttatcgacaaaatattgccagtaagttttcgttccggtgataacggcggcctgtcctgcgataccgtagtgcaaggtctgccgctgttgtttactcagtggcactcgtgcctgtactttaaagtaattgccaactttagcattcacagttggtgcgacatcaatggcatcaatccggccggtcagcgtcatcggtgatgggacattctccgcaattcgcagccgaacgctttgaccacgtttcaaactcatgatttccgctggcgaaactgccagcttcaactcaacttctttttgcgtggctaagtctggcaagatttgcgccaaaacggtgccagccggaatgtacttgttgccacttaaggatgcttcaagatgcaaaacgccgctggcagatgctttgacttggtaattcttactttcgtcctttagtgccgccagtttcgcctcgccttcttgggtaccttgttggactttcacctgttctgcagtcatggtttgctgcatatggctttgcaacgaggccagttttgcctcattctgccccgtctgctgcgctgaaagatcggcctgcttctggttgatacgttgggtgcgcaaggaagcgagggtttccttttcggttgtcaataagttttgcaactgtgactggtactggcctttcaagttgttcaaattagcagcatcggcattcttagcctcggctttatattgcaaataaagatagttgtacgtgtgattgtcacttaatggccgatcggttcgtatggccgtttgggcctcacgaatcgccgtcattttagcctcgcttgcctgcatactggtttgcaacaattgatcgatttctttgctcttaccatcggccacaccttgggtcgcatgcaaggcttccgattccagttcgtaaacccgacgttggctgagataatcgcgaacttgttgctgataaccgaatttatcaggactcgcaaaaaggtttttattggcagcaatactctggttgagaacttcgagctgcactttttgatctttcaacgtcgccagttgctgttcaagcactttcaattgtgcaggatgagctacatcgtgatacaccagcagcgtgtcgccgcgtttgacatgcttgccttctttcatatgattcgtcacaattcgattcgccgccgtcccttgaaccgtgaccgccgttttgaccggcgcaatttccgccgctgttaaaacggtcacctcgcgcttggcgaagatcagaaaaagcaacaacaaaacaaaaaggatcgcggtcggcacaataatgactgttgaaaaattacggtagcgatggttataaaactcggttgtctctaacttctttagatcaatcatcgcggcctcctcactcacttaccaaccgagcataatagccttgtttggccaataactcagtatgatttccttgttcaacaatcgcaccatggtccatgaccacaatctgttccgttttagcagcaatagtgagccgatgagccacaaaaataatggttcgatcagtcattgctaacaaccgatcaacaatttttcgctcggtgatcgtatctaaactgctggtcgattcatcaaaaatcaacacttttgccggtgataataacgcgcgggcaatggctaggcgctgcttttgtccacccgataaaatactgccgctttcagaaagtttggtctgccatatctgcggcaaattcgaaatatctccggcaatttccgccactgaacaggcagcttcaatatcggcttcagtgatattcgaacggctacccaacgttaagttttcaatgactgagccagaaaaaataaacggatcttgtggtacatactcgatatattgtcgtaacgttgttagatcaacatcagtgattggaaccccattaaatgtgattttccctttgccagtgtccactggatagaaacctactagcaacttggctaaggtcgatttccctgatccactcatgccgacaatggtgtatttggcattttccgggatttcaaggttgatttgtttcaaaacatcttgcccaaaaccatacttaaaggacacatcggtaacattgatggcgccatcaattaaatgccgatcattcaaacttcgctgttctttaaactccgattcaaccaaatacacttcattcagccggttattcgcgactttggccatttgcaattttggttgcaaattaatgatgctttctaacggattggtgaaatatgccaacaacgcattgaacgtcagcatctgtcctagactcatcttgttagccatcaccaaactcgcaccaatccacagcacgaccacattcaaaaccaacttcagcagtcccttgatcgcctgctgcagttgatcagcttttgtataattgaacgactttttcaaatacgtgacgaattcacggtcaacccgttcataactgactttctcaccggtcagtgatttaatcgtctcaatcccgttcaaatcctcgataatagatgaactcaaaatggcattgctttccatcgtctcttgattcagtcgattaaatgtccgctgaaaagcgaacacaatcaccaaataacaaggcacagcaattaaagacaccaagaataaggtggtgttttgaatgcctaacacgatccctaaaattaagacaatccaaatatcaagaaacaaggtcataatcgtgttcgccagcgcatcaataattttattagcatcggaaaaccgcgacacaatttccccagtccgacgcgtggaaaagaaggacataggtaattcataaaggtgtctgacgtaacccaaaatgacatcaatcgacaaacgttgtcctaaaacagccatcaaaaaattttgcccataggttaaaaccgactgcagcacataagcgaggatgagaccactggcaatcattcccaaagttgtgcgcatcccgtttggaatataagtatcaataatcgactgaagaaaataagacccgacaatactaatcaacgtgatcaacacagcggcgacaataatattggcaatgattcctttttgtcgcgctagcatcggcacaaacgcaaagagactgcctttgtcctctttgcgtggttgatattgcggttctggcgcaataaaaatagcgacccccgaccactccttcgcaaagcgctctttgggaagccaggtcatcgctactgatgaatcaggatcgccaatcaagatatgatcctttgtcgccttaaacaccacataataatgaagcaactcgccacgcttcaaaacatggacaagaaacggataaggaacatcatcaagatcaaacagcgtcatatccgccttgacagccttggtttcaaaatgaagcgcctgagcagctcggacaatccctaacgctgttgttccttcctgatccgtcttcgccaactgtcgcagatgcgctagcgaataatccgagccattaaattgcagcagcatattaagcgccgcaaccccgcaatcgcgctcatccacctgaggcgtgtagtaacgcttgtaatactgtgcttggccgagctttaggttgtatttgatcatgggcatgcctcctggttggtgctggatttttctaaataagtgataccttgaactgtttaaaaaatgggttgtcgttatgacaacccttaaccttacagaagagaagactgtcccagaagccactaatcagtcaaattctgcgaaggcttgtgggacaccattttctctgtaaaagcgtttaacataaaacttaaaatccaagaaaattgtgcaaagcatgaaattgtttagaaaagatatgatatactatcaccgataacgcatcacccgttttaataatatataaagttatttttatatattattatcatagtaatatgataatttagttaaaaataatcaacaatctaattcttttgttttaaaaagctgccataacaaggttagttaccggtcttacctttatttcatctaccttaatgatttagatgcgagcgaaaactcgtaaacacgatttccctgatttatttaaacagaccatcaaaccatcttcttattttgttgaatgttggcgaaacatcacggatgctgtcacctccaatgaatccaaaaagttcttcgtcactcatattgaccattttctgctcatcaaactgtttcatttctttttcctcctcattcaagttgaagtgttcttttgctttacatgaattcaatgtaacagacttttggcttgttcttgttttccaaaaataaacgtagggttttcgccgattaacgtcgcttctacgtctcttcttagtttgttacaatgattttttaaccctactcagcattcagaggtcaactccatggaaacttattctgatctagcctatattcttttaacatcacccgtgttcatcctaggcataacgtttctgtcatatatttttttcaaccgaattaatctcattcacattttttttggtccatcttagcgatagtgttgtctacaacactatcgctacttggtgaaatcttctttggattgatctatgcctactacatgtcaaaaactcataaccgatctgatgtattctgggttttcctatttttggaaatcaacttgattattgtcaattttcaaacactactggaaaagtccttcacgttatcaatgaccaataactttttctttataagcataacgtctaaattaatcaccaatatcgtactgctcatattggctatttggttgtttggtacgaggaaaaaaattgtcaataatatgcgtcatttggttcaagaaaaagatggtatttggatgtcggctatcttttacctaggtgcctcttgcactgtcatgtactttctagagtttacctttatactcctaaagcttgataatgttcttgctctactcatactatctgccttcatttttttcatggttgtcaatttatgctctctattttttattttgagatcttaccgatactatcttgagctactggtcgttaaacacaccaatgaatcacgacgagcttactatgcatcacttaaccaacaaagggaaaatactagcaagcttcttcatgattataagaacctactagcaacgctacaactttcattgcaacaaacttcagcaagtcaatcttctgacacgagcaatatcatcgcgcaagctcaaaggtcaatacaacaagctgaaagtggcaaggactcattagcagcaatcgaaagtgatccgcttcgaaatctcctctatttgaagtggtcagaagcgacgaatagtggtattagattacacattcacaccgaaggaacaatccaaccgctgagtaataatgccggttttgccgtcatcagagcacttggtatcttaatcgataacgccttagaagaatctatcaggattaacaagactcatttcagcgtcctgctagtggcttcagatcgggggctagaagcaagcgtcgtcaacgatatcaatgatgatttcaatctagcaaaatttgcagaacccggtttcacaaccaaaggccgcgggcatggcaatggcttgaccatcataaatgagttaatccagcagaataaaaatatcatcattaaaaagaccgttattaacaagcaactaaagatcactttgtttatagggagatgacttcatgaccaaccaccaaacgatgctgaagattttcattctggaagacaatgctgacttcttgaatttcctagaaagtacacttcgcaattatattatgattgaggcattgcatgccgaaatcaaattcaccactcagtcagcgacagatttgttagatgctgttgatctagaagagattaatgactgcctttttctgctggacattgacatccctggatcttctgtaagtggtattgacatcgccaccatccttcgaaaaaagtctttatacgctgacatcatgttcatcaccagtcacactgaagaagccttgtcgattctggcccacaaaattgcgcctttagacttaattgataaaagtgttctttttgaagttgaagcgcgactgcgatcaaatattgtttatgccatcaagcgattgaaggcgcgtcaattgcaatcgccacgactttttaattacagcatagattcaaatctctttacagttatattagatgcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcatggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgtcgccattaaacgtgtcacccgatcgacaatggtcaaaacagcagcctttgacccgcgaccaccgcgaactgtatccatctctaaatgtcctttttcggttcgccgattagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctagggatgagctactttacattcaaacaacccctggtatctctggcacgttggaactacatgcagaacgcgaaatcgcaacctttccgggaaacctgaaggaggtatcgctccaatacccaacattgtttcgctgtcatcgaagcattttgctcaacccaacgcatatttctaaattggacacgcatggccgttttgtttacatggataatcaagacaaacttgaggtcagcattcgtagagtgtcggccctgcgtcaggtcatgatgaccgcgaataaaccacagtctgctaccaatgatctgtcaaacgatgcttgaatggtatatctcttttttcgtgtctctactagaagcgaatctaaacggtgatgaaaataaaggtcacttgaaaaaactccaatgttcccataacctggcagaaatatcaaggtttctagtaactgtttcatttaactgctgaatacgacaacagattcagtgttgtttcctctgaatctcttacagcagtgcttactcattaatgatgtttaattttgagatataaatacaccttagtccagctgattagttcatgagaaacaggcgctgcaatcaaaaactgtttcagtcattgattgcagcgcctgtctatttgatgacacctttagaataacttttaagaagcgacagattctcaaacctatttctttaacttgccctggatgtaagctgattcctgagacaacttttaagagagggtataatgaataaatcatctctcaaaaggaaggaatttttacatgccaacccgttacgacaaagaattcaaacaaaacattatcaacctatataagcaaggcgaatcagctgcccaactggccagagaatatggcattggctattcaacagttcataagtggatccagggccaggccaaaactcaatccggtaaatcgccagacgaaatcaaagtgatggaaaagcgactggcttcgctgtctgaggagaacgaaatcctaaaaaaagccctgggcttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcgggcttgaaacaacggattctgcggatctttgcggaatttaagcagcgatacggtgttatgaagatccaccatgaattgaatctggaacttcaaccactgcagcttcggtgcagtccacgacggatttcccggctcatgaaggaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggtgttacttatcaaccatcatggacctccactcacgacggattatcggctattcgttctcaaaaaagatggatactgatttagtcttaaagacccttgaaagcgcggttaaaaatcgaaccattactggggacctgattatccatacggatttaggatcacagtataccagcgatgattacaatcaacgtttaactgagctacatatccgccactcatacagccgtaaggggtgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgatttaatgctttccagggttcaaataagttattaatcgcgattaatgatttatttgagctgtggaaggtaaacgcggttctgaatgtctcttaaaatctgtctcaaatattgacttcaatccaaagttgaaaaaatctcctttaagttggtagatgttgtcctccttgagtatatcaagcatcagttcttaagatcagcttgcgcatgaaacgagatggctaaccaattctacaaaccgattgacaaatcacaaactgtgggacttgtcagctagactccagccacttgtggcaccaccagcaatttcatctgcgtgactccacgcatccgatgctaggaatcccagaatggcagccaccgggatcacaaatgcaaaaccgccagtgatctggctaagttctttatcttttaagttagtcatggtgtacatcctttcttcctgtttagcttagaagttagtttttaggggttagttgcttgacaagatctattacaggacccctcgaaggtacaaacagactaccagtaagcacgcttcgcgcggagaatccaagaccgaagccaatgattgaccataaaccaccgttttcgccaccagcaatcttttccaagctgctgttatctaaagtcatgaattgttgcattgttatccctccattttctttgagtgattcattgctaaacatttggttcttaggtaaaacggtcgggggtgctagctaccctacacacaatatacggctagcaattgcttttgtggtgacttaaattttaacgttgatattttcaatttttttgtcagttctatcgtcaaaaaatctaaaatgcgacgaaaaaaggggattttacgacgtttattttttgatgacccatttttcttgaacactagttattatgagtatgaaatgatgtaatgatactgaaagtttaaagatgctgagcataacccaatggagatgactttcatgaatgcatacaagcagttgaaacaaccactgtcaatgtggatcattaattgttgcttagtggcgttgctctttcttgttcccgatgattcaagtatctttgtctatatcgtgattgacctcgcaatcgttgctaacggttttgatttattaaagaaactatttggtctgtcaaagcatgcggactggcaccacaacacttggaatcgtgatgaatcaaaataagcctacaaactaagcgtcgcctcgtcatcgcttaatttgtaggcttgtttttttgacttttttcacacaccacaataaaaataacgagaaagatcaaatagtagcgatcaataaatgaaatgtgaggtaataaatctagatcacttaaaatcagccaaactatagcaaataaaaagccgccaccaacaataaagctgctcacttttctaaaactcataaacagacccactctctatcattcttcaacaaggttcgtttttggcaataacgcaaacagttcattcaccgattgggagattaaatgcattcagacgttatgatctgtatctgattcacttcttcttttcatcagatgcacacaggctgtccagacatggcgccaatgtacatagaagtaataatggtagtacaaaatcaccatgattagtccagccgattgctgatgtcactgtataggtccgataggagaatgcctccaataatcaggcagatcttgaatgcttttgccattcgaatccccttttcggttaactaagttcctcagtcgtgctgttccgacataaacctcattttgacaaccttgccatgaacccttctttgtcatgacagtgccataggacccacatggaaatgaccaagtaaatcgtatcccagatcaacgaaacagttatgagcgtcgtttcgtcacttaccccatttaatttgctgggataagggccgtgaatcagcgttaccaagaagtcgatcatgaaatgaacaaagatcggcatcagtaatgtgccataacgaacgtagagagcagccagcagcatgcccatcccgctgacttgaatcatctgacccacagttgcaacagcaccttggcttggcagattactcaagtgtgcaagcgaaaacgccagactgcttagtaacatgcaatagataaagttgcgcctggtaccaccacggttagcaaggtaaaaggcgcggagcaagccaccgaaaataactccgcgatataggtactcttcaggaacagcggcgatggtaccaatgacacttgcttgtaaaatatctaagaagtttcggttggtaaagatttgccaagccacaaggcagcccacaatatcccagaacacaaatttctgccagcttggccagccaaatgacgtcctaaagataatcttttgtcttaacagcaacagattgagtccaagaatggcaactaaactaagcaccttatagagcacaatgtctgcccaaaaattcagctgtagaaaattcaaaaatggggtgaacacaaatgcttctataagttcatccaagataaaaatgtataaaacacgtaatccaggcgtgaacaactgttgccgtttctttttcattccgtcaccttcattcaagtttacaaagccggcatttttacgacattgctatgaacaatataccaattaatgaatggcgtttagtcaactaattttaaacgtcgtgttttcgccatttaacgttgacgatcatccgtcaaaaattcgctagcggtcatttattgacaaaaaaagccacttcactcggcaaacgacgctacgctaagccaagaagaagtgacgctgcagtgttgaaaaagtcgcggagcttgcaattggcgcaattcttcaccggtcacaaacacctacatgccctgccatccctttaaaaaccccgcaataatttggtcagtgtgtgaccaagcatctatcgcaatcaatcctaaaatcagcattgtcagaaatttacgccaggtcatcccgtcaatcatttgttgcaaatcatcattctttattcgatgcatctcatcgtgccccttccccaaccagtctaaatcaagtggtaagtcacaggataaacagcgtaacactcgacttccgacttcgcatttgcgtgtgccaatattgggaacaaaccgatcaagtaatgaagtgcggtccgccaacctgactcagctcttcatgaatatcattctccatgaaatctttcagttgttgccaccattgatcagcttccggcgataatttcatcccctgcaacccaattaagcgaacaaagcgagaatacaggcgagctaatgcgtagtcaatggctctattttgaagcatattttctttttccaaaatgtggagcgcatcatcaatgacctcttgtgcatcggtattcatgacactgacggttgcagtctgctgaaagctttcgttgagccctgtcataataaaatagactttatttcgctgaatcatgttcatgatatgtcaccatttcctttgatgtcgtgacaatttttctatagaaatgtttgaaaagtatcgatgctatagcttttaggcaaagcaccggaaaacaatggctttatagcccgactgatggatcttgataccgtcttgtatttgaactcttttagatatgagtcatcgtaaccgattacattttaaaatcagtttgtccttgtgtacagaaattcggcctcacgtttttctgccttctaagcagacccaattcaatgcctcgctttttcatttccagcatcagcttcccgcaacaacgtgagtcctgccgccaaaagcagtagtggcagcgcaaagtcaccttggttgacccagcctatggcggcagccagcgtaaaaagaaagacaccactgatgcctatcagtaaaagataatgaattgctttattcaacgtcatcgccaacttgtatccccccgtccagatgaacttcgactttttctcgcggatgcttttacgcacactatactggatagttcacacaacagcgcaaactttttttaaacgtagggttttgcccgattaacgtcgcttttttgtcaaatatcgaccaaattttctctttatcgatctgctactcggtttttcttaactggtgtcaacaagtttcatggcaaaaaaatagccgcagatcttagtctgcgacgttttttggcaaatgataactgattgatcatcaactctagcctcaccgtttaaaattcacagccccacctcggctagtgtccccaaacaataggaatggcgattaagccggctgccagtgcttgtgcacgataatgtgctgcatcaatatcggcagcaggtacatcttttttgatgtaattgaagacggccaccagctcttctggtacggcgtgatgaatcagatagtatttggaaatgtcgtgggacaactgagtgacagccgtcacataagccttatcgtcatcaccttcatcaacctttttggcgttggtttcgataagcgcccgtaatgccggctctgctttgatcgttgggttagcgtatgccctgcttagcatcgacattaaagtttcacgtttatctgtcatcctgcacttcctttcgatgattaacttggcaattcatgctcactcggagcaccttagtctttgtgaatattgttaggatgcgcttgtcaattgctaatttcaagtatcgatttggcgtttagatcatgtcatgccctgcaaaccctgttttatcagcagccgtgatctcgcggagcacttcgcaaggattacccgccgcaatcacgcgcgctgggatgtcgtgggtgacaacactacctgctccgataatcgtccccgcaccaatcgtgacgcctggtagtaccgtcacattggcagcgagccaacagccatccccgactacaatcggtttagcaatacagccaccaagttgtcgttcaagcggatcaaaaagatggttgctggtgtacaaaccgactttcgggccaaacaaaacgtgattgccaatggtcaccggcgccccgtccaaaatggtacagtcataattggcataaaaatgatcgcctacgcggatattccgaccaaattcacagtgaaagtttgggttcacaaacggtttgaagccagtttggcctaccaatttcctaaacaaggcattgcgtttggctggatcgtgttcattgttaagtgcatcagttttggcagttgcttcatcccgcacagccagtaacaaaggatccatgtcgtcgtatggcttaccagttgccatgaaagcaaatttttcttctagattcattgcgccacccctctttattggctcaagtttaccagacatttgcgcactgcgttgataattgccaatatgttaaggtgtgcttatcggtacgcatgaagtctacaaaaagccaccacttcttgaagaaatggtggcttgaaaacaatgacatcgcttctgcacacagaaccacgcctgttttgttacaaacagaaacatacagttacagtcttcatcgtcacaaaattctggcgttaggaaatttcagctacttcctcggactttatcagcttaatccatagacttaatctcaagtgacattaactcagattttagcttttttaaatttgacatagagataaatgtaaagtcaagtcttccatctagagtagtgagaactatataagggttctggggattgattaacctactcagccccttactagatagtttcaaatcccgatttaacaaaagtatcttggcaatgactttgcttcttgctgccccttgccaaagtcctccaacaaatggtgctagataaaaagcgatcgtcgccagtaaaatcaagataactatgatgatacttattatcttatccatttgtatttcctcttccttttgcacaaatagactaatttgaaatcgatctttgactaagacaagaaaaagtgagcactaccaaggtgttagttatattgaacagttgcgataggagctaaccgtctttgtccaatattaggctgggtgaatgtaattagtgctgagacacaaggataatcctattgcagcgcctgcaacagttgtaaatggatttaatccagctgcccctgctaccgctcccccgatcgtggacacaatacacccactaggtttattgcgtcgcttggctcctccttggattaagaccaaatcatgctgttttaaagtaatgcccacttctttacttatcattgcatcccatctcctaagcatttaatagctgacccaaccgctcctaagtttccaccaactacggcgccgccgattatcccaaaaggaccaccagctaggccagtaatcgttcctgatccaataccagccgtgatgccagtaacaaatgtagcagcacaatcaaatttctttttcccacctgaaacccctgacaactgaaaatcgtcgagctggcgataattataagacataattttccttttttcttcaaaaagcaacaagttattttgtgtaaggtcgattttactgtctttaacatacattaattatttgtgtaaaatgccaaaattttttaaaggtaggaaatttccagtttaacgtcgtctttacacttttattgttcagttgcgctttaaaagtcaaaaattcttaacgtttaaatctccttgcttggtaaaaacttcaattttttgcaaaaaaaatcgtctcagcaatttgagacaattttttcatatcatcaacttacggcaagtcattccccgccgcaaagtaaatgtcataccattcctgtcgggtcaacgtgatgtccgcgccttccgcactttccttgatatgttcaggattcatagagccgagaatcacttgcacaccgactggatggcgtaatagccaagcgactgcgattgcatttttattggtatggtagtggtcagcgactttctgcagttcatcattcaacgccttaaatttcgggctatcgatgaaggtaccttcaaacatgccgtattggaatggcgaccaggcttgtaaggtcatgtgtttgcgttgcaagtatggtagcaggctgccgtcatgatcgacagaagccgcgtcggccatgttggtgtgcatccccgcattgaccataccagtgtgcgcaacggagaactgaacttggtcgatcagcaaaggctgccgaatgccgctttcaagcaacgcaatttgttcagggttaaagttggagacaccaaaatgccgaaccttgccgctttgttccaatgcatcaaaggccgccgcaacgtcatcgacttccattaacggatctggccggtgcagcaagaccgaatcaaggtaatcaacctgcaaccgtttcaaaatgtgatcaaccgctgacagtaagtgatcttttgaaaagtcgtaccgtttgccgaataccaaactgccatgagagcgttttgaatcaacgacgatcccgactttcgattgaatgaataactgatcgcgggaaacgctggcttgcttcaaggcttcaccaaaaacttcttcggatttgccttggccataaatgtcggccgagtcgataaagttgatgccgtcattgtacgcactatccagcacattggccgctttgtcgggggccagcacattcatccgcatgatgcccaaggccacacttgacgcctgccaattggatccgcctaatcgaacttgtttcataaacacaaaactcccttcgatacgtcatttcaaattatgttactgacgacaagttaagtgtagcccctaaagtccacttgaggtcaagccaatattagaatttcaataaaacagcttgcatggtgctgagctgcgcggtaggttaagctgtgtctgttacttattttttcttagcaggataagcccataaaggaggccgtgattttgacagttaaagataaagtggttgtaatcacaggtgcatcgagcgggattggcgcggcaacggtacaagtgttggccgaggctggtgcaaaactagtcatcggtgcgcggcgcacagaacggttggctgaattggcggccagctttacgaacggtcaggtgctgtatcaacaaaccgatgtgaccgaccagcagcaagtgaaagcgctgattgatttggcgttggataagtttggtcatgtggatgttttgtataacaacgctggcctgatgccactttctgaaatggccgaactcaaagtcaacgaatgggaacgtatgattgacgtcaacattaaaggcgtcttgtatgggatcgccgcggttttaccgcctatgattgcccaacacagtggccaaattatcacaacagactcagttgccggtcacattgttcaccctggaaccgccgtttactccggtaccaagtgggctatccaggcgatcatggacggcctgcgacaagaacaagcggctaatcatattaaaacgaccatgatctcgcccggtgccgtgaatactgagcttttcagcacaattaccgatcctaagcgccgtgaagctgttgaagccgatgaaaaaaacaatggcctcagcgcctcggatgttgccaaggcagttttgtatgccattgatcaaccggccaatgttgccatcaatgaagtgctcttacggccagtcacgcaagaacgttaattttcgtctaaaggagtgtgattgcatgtcgggttatcattttttaaaaccgttcaccttcaagcaccaaaccatcacgttgaaaaatcgcattgtcattccgccgatgacaacgcgcctgtcgtttgaagacggcactgtgacgcgggacgaaatcaggtattaccagcaacgggccggtggcgtcggcatgtttattaccggtaccgccaacgtcaatgcgcttggcaaaggattcgaaggtgagctaagtgtcgctgatgatcgattcatccccggtttgagcaaactcgccgctgcgatgaaaacaggcggcaccaaggctattttgcaaatcttcagcgctggccgcatgagcaatagcaagattctgcgcggtgagcagccagtcagtgccagtgcggttgctgcgccacgggcgggttacgaaacaccgcgcgcattgacatcggcagaaatcgaggccactattcacgattttggtcaggctgtgcgccgcgccatccttgctggttttgatggcatcgaactgcatggtgccaacacctatctgatacagcaattctattcgccaaactctaatcgccgaaccgatgaatggggcggtgaccgcgataagcggatgcgttttccgttggcagtcgttcatgaagcagaaaaagtgattgccacaattgctgaccggccatttttgttaggctaccgcatttcgccggaagagttggaacagcctggcattaccttggatgataccttggccttaatcgacactttgaaacaaaccaagattgattacttgcacgtctcccaaagtgacgtttggcgaacctcattgcgcaaccccgaggacacagccatcatgaatgaacaaattcgtgaccatgtcgccggtgcttttccagtgattgtggtcggtggcattaaaacccccgccgatgctgagaaagcggcagaatcctttgatttggtcgcgattggtcacgaaatgattcgcgagccgcactgggttcagaaggtcttagaccatgacgaaaaggcgatccgttaccagatcgcccctgctgatcttgaagaacttggcattgcgccgaccttcctcgattttatcgaaagtatttccggtggggcaaaaggtgtcccgttaacaactgcgcagtctgtgacatcaagcaacgtgactcaagattaatctagcatttcaaatcatcgtgcgagtcgagctgtaaaaagctcggcttttttcttgccgtcttcaacttacgcgctggtgcctgaagctaccagtgatttataagttttaaatcaaggtgtgatcatcacctgctcacgctctgacttaaacgcgttcgctggcgcagctcggctatgcgaaggacagtgacacagatggtccaaagcccagaccatctgtgtcactgccacttcgctacgccgagctaaccacgccagctcacgctcttgtcatttttaacgggtcgacccatttatcaaactgcgctgctgtgacgtcgccgcttttgatggcggctgcttttaaatcgaggttttcttgctcagccaattgcgcgatggcggcacttttttcgtagccgatgtggggtgcgagggcggtgaccagcatgagcgaatgatcaacgagtgctctcatatgcggtgcgtggatggtcaagccggcagctaatttttcagtgaaactcgtgactgttttggttagtagatcagctgactctaaaaaggtactgatgataaccggcttgtagacgttcaattcaaaattgccttgtgacgcggccaccgtgatcgtcgtatcgttgcccatgactcgaacagcggccatggttagcgcttcggcctgtgtgggattcactttgcccggcatgatggaactaccaggctcattggccggaatgcgcaactcgccgtatccagcacgtggaccactggcaaggaagcgaatgtcattggcgattttaagcagatccgccgctagcgttttaatggcaccatgaacaacgctaatttctgagtgtgccgctaaagcagcaaacttattggttttcgccgaaagtggtaattgataaacatcgctcaatcggcccgccacaatcttgccaaaattagggtcagcgttaagccccgttccgactgctgttccgccaatggctaagtaaaaaagattgggctgaagctgctttaaagcaatctgatcatgctccatcatggccacccatccgctgatttcttggccaaacgttagcggcgttgcatcctgtaaatgagttcgaccgattttaacaacacgagcgtaagtgacggcttttgaatataaaacactgcacagttggttgacagcgtgcaacaactgattcactgcaatagccgccgtaatattcatcacagttggaaaagtatcattggagctttgactgtgattcacatcatcattcggtaagatcggcaagtcggggttgagttttgcagcttggtggctaatgacttcgttcacattcatatttgtttgtgtgccagacccggtttgatagacatgcagtggaaaatctttttgcagtttttcgtctggcaaggccaacaaggcatcgactgctcgcgtgattaattggccttttggtgccggtaaaacatcagcggccacatttgctcgcgctgccgcttttttgagttgcagcaaggccctaatcactggcatcggcatcaatggaccagcctgaaaattatggcggctgcgctctgtttgcggtccccacaaagcgtttgccggaatttcaactggtcctaatgtgtccgtttctgttcgatatttgctcatgtttacctccgtcatcaccatcagaaaaattcaaccaacatgcctatttgcatagacctattttacacgaattcgcccacggttaaacaactcaagtaaaacaaaaagccacccagcacggctaatcgccgtttagtgcaatattgtttcgacaagttgtgccgcttcggtttgagctttgatagaaccagtggtcagtaatgacaagtagagatggatcggatctgcctgtggtgtcgatataccaccatgcagccgacgactcaccgtagccggatcaactgaccatgtttgaatgatgactgcgcgactatcatcgacacgatgcttgctattggcaatttttagggttaattccgccttcagtaaacgatcatatgcagcctgtgagacagcataaatcaacggttggttactgccaaatatcgctgccttaattagaacggtgccagccgcctccaaaggaaagttttcactgaagtcaccgctgattttcagcaactgttcaaactcatcagcagtgtatgtgcgggttgctagaattggcgatgtcattagaccgttatattgcttgaaaagcgtccatggatcatttgccagttgataatgcttatgagttcgatggcgatcggccaataaagcgccagatacctgtagttccaatctagcgcgcttcatgattgttcgactgccaatacctgctaattggccaaaatcttcaaaaaactgccgcccgccgcgaaacgacagacgcttcttgctgccgcttgcctgagaacccagacgatcagcatacataagactgatcagcaaatccgttgcatgttgcgacaacatggctggcgtttctaatagctgtgttgacgtgcttgtgtcttctccctgcgccatcccatcactcgctttctatattgtttacctattcatgagactatgaaactttagctcctatgctttctgtcataacgtgcaccggcttatacttaaaaaagccgctttgatcaacaaacagatgatcaaatcggctttactaggaaaactgacaacgataatgattatttggttgaatgcgtggccgtcttagattgcatatgatctaacccaagaatggcgaatagccaaggatcgtaccccacagattcctcgatcccatcgcaactcatggccaaagattcaaacaaatcattgttcgtcaacatctgccttcgcctctttttcatcggctacagctgcaagatgtgcttcataacgttgattgcccttatacagatcccagatcgtccaagcgagtagcgcgaggatggctacgatcagaacaatggcaatgatgttggccatgttggtttgtgtagccgttggatgatcgccgaagaatccggcgattgaatctggcaggcctttaaggttcagtccagttaagccgagaacggaaatccaaccgagcactttgacccaaccagtgttcttgaaccgatcgcccatttcgactttactgtttgtgaacatcaacagtggcaacattgagaatggtaacgcaaacgctagaaagacctgtgaattgttcatcaaggtatttaacgcctcatgttgctgaattggcgtgtctctagccgtcaacataacacagacgataactggaatgacggaaataatccgggtaaccaaccgtcgtgcccacagaggcattttcatatggacaaagccttccatgatgacctgacccgttaaggtaccggtgatggtggagttttgacctgatgccagtaacgcaaccgcgaacagaattgacagaataccagatttagcaacggcaattaaaacaccattacttaaggttgaagaatctgacaaagcttggaacaagccgaagaatgatggatctttaacggcaccactcttgaagactgcgacccccataaccaacagcaagcagttaacaacaaaggcgaatgacagctgaatgttagaatcccatgctgagaatttaacagcttgtgccacatcatccgggttcttgtgatcaattttccgcgtttgcgaaatcgcactatgcagataaaggttatgcggcataaccgtcgcaccaataatgcccagtgcgccttggataggactcatgccgttaatcgaaggtgaactagcgaatgtttcaccggttggaatgaatcccttcagcaaagcacccatgttcggatcggacaaagcaacctgataaacgaagaccagtaaaatgacaagaataagagcaacaacaatggcttcgatctttcggaacccgatcttggtcaacagcagcagcaccagcacatcaagcaccgttaccagaacggcgatgactagtggaatgtggaacaacagataaagcgcaatggcagcaccgataacttcagcgatatcagtcgccataatggccaactcagtcaggatccacagcacaatccctaacttcttcgacgtccgtgcgcgaatagcctgtgcaaggtccatttggctaacaatgccaagtttagctgccatgtattgcaatagcatcgcaatcaaacttgacatcaggataacggaaatcagtaagtactggaagttttgcccacctgtgatggacgttgaccaattcccgggatccatgtaaccaacggcaaccaacgcccctggcccggaataagcaaaaagcgtgcgccaaaaccctttcccgtgcggcacctcaacagtaccgttaacttcttccaatgacggcccattcgcgtattgaatgagcttaattggatggcgcttcttgtgatcatcactcacaataactctcccctttcgtttgaaaaaagttaagtccctggggaacaaggccttttaggtctccctaacttaatcctttcttaggatatgcctgtactgatatatcgtcaaccgttttatgaaaataatttgtgtttttaaaggaaaaattgtgaatatagccatacaagttattactcagaattgccgttattgttaaaaagtcactagtgtgaggatgttcaaacgtcttttcggaaaatttatcgacccatcaggtttttcaacttttctgcaaatgctagtgtccccataaccgccattaacaaattgtttgcaaccggtttaggcataccatattatatagttggcaacaaaaaatttatattatgaaatgaggaatcatgcatggaagaagttcctgactcgcaaccacctgcgtctgcacacagtatcaaggacctgcagcaatcgttgcaggtcccgtcccttgaccacggcctttctaaagaagaagccgctaaacgcctgaaggcgaatggaccgaactcaatcgagtcgcatccaacgccaaaatggctaatttttctgcgtcagtttaacaatctgatcatctatatcctgatcattgccgcgattttgacaaccgtgataggtgatgtaaccgatacctcagttatcgttttggtcattatcatcaatgccatcatcggctactatcaggaaagtaacgccagcgattccttggaaaaaatcaagaaaatgctggctcctgaagccacagtttaccgtgacggcgaacggcttgatatccctagtgccaatcttgtggtcggtgatgtcgtcttccttgaagcaggcgataatgtcccggctgatttgcgcttagttgatattgataatctcaccattcaggaagctgtcctcactggcgaagccaattccgtcatcaaaaccaccgcaacattgccagctgacacaccattagctgaccaaagcaatattgcgttcgcctccactgccgttgctggtggcagtggcatcggcatcgtggttgccaccggccatcttaccgaattcggtaagatttcccaagcggtatcggatgtccgcaaaggccgctcgccgatgatgcgtgaaattgacggcatcggcaaaggcatttcctatgcgatcattgctgctgccgtgctgctgttcattttcggcctcgtcattggcaaatacagtctgccggttctcgccttagccattgtcacgatggtcgtcggctccatgccagaaggtttgccagccaccacctcggtcatcttggccatgggcgtgtccaacatggccaaaaagcagcatgtcattgtgaaaaccttgccagctgctgaaacgcttggctcagtggatgtcatctgtaccgacaaaactggtacactcaccaaaaacgagatgacgattaccaccatcgtgacaccgcaagcaacttacgatgtcagcggtaccggttatgcgccgactggtgacttttcaatggctggaaaagtgattgatccagctgaacatgccgatttatcagcattactgactgctggatttgaagccaacgacacggaactgcaccaagaagatggccgttatgttatcaacggcgaacccacagacggctcgtttctgactgcttactacaaggctttcaaacaggaaccggcgaacaccgagcgcgatctgatgccatttgattccaacaaccggtacatggcgaagttagcaaaatgtgtcgatggccaaacgagactatttgtcaaaggttcccctgataaaattctaccgttagtcgccacagcccatcctgattttgatcaagaccgctacttgaaactcaccagccagttcagtgttcaaggccaacgggtcattgcagttgccgaaaaggtagtgccaaacgccacaaccgaaattacccctgaactgctcagcgaaggacttgattttctcggcatcaccgcgattatcgacccgccgcgtgagtctgtcatcacggccatcaagcaaatgcgccgcgctggcgtgaaggtgaaaatgattactggtgatcatccagaaactgccatcgcgattgccaaaaaactcggactggctgattccccaaaagcggtcaccggtgcgcaattggcgggcctatcagatgaaaaacgtcgacaattgattcttaatgctgatgtttttgcccgaacgacccctaaggacaagctgaccatcgtctctgtgctgcaagaagcaggcaatgtcacggcaatggtcggtgatggtgtcaatgatgcgccagcccttaaaaaagccgatgtcggcgttgctatgggccagtctggtactgatgttgccaaggatgcagcggatatggtactgaccgatgatcgctttgctcgcatggaaactgccatcgcgcaagggcggcggatttaccagaatatcaaaaagagtattctgttcctgctgccgacttcatttgctgaaggcttggtcatcgtgttcaccattctgacgcaacaagaaatgccattgcgtgccagtcaactcctgtggatcaacatggtcagtgctattacgatccaatttgccttcattttcgaacctgcggaagccggcaccatggatcgaccaccacgtaagaagaacgccgcgatgatgcataaacacgatgttttccaaattgcttatgttgccatgttaattgcaggcatcggcttgtgggcgtttgactggttgaccgccaatcatctaaccgatcgcacaacggcaagtaccatgatggttaacatgattgttttaggtaaaattttctatctgtttaacattcgcaccaatacattggcactctcaaagaacctgttcagtaatcccatggcctttgtcatcattgggatcatgctagcattgcaatgcttcctgacctatgtgccgtttatgcaagacattttccaaaccgcaccgatgtcttggcgtgaatggggactggcgatacttgccggctcaatcattctcattgtgaccgaaattgacaaaatcattcggatccgccgtcagcgtatgcgcggccatggtgcctttcggtcagtaaccaaaacacaaggataatgtttggcctccctaaattttttcttccaattttggattgatcatggtaatactataagtaaggtttccctaacaaaccttatgcgtatttagaaggcctgacagccagatcgaccatcactcaagctgtcaggctttttgaataccttttttcttttaaataaaggcgttatcagttgagtagtcccgaatcctacttagtcacatcaccaaaaattatttcaggcttacctaatatttctcttttaaatatcatcataactgctatactaaaagtgaaaagaagaggagtgatcgttttgaaattgtatcaaagccttacccaagtccaaatcaacgaacaattcgctggtcaagctagcggctacaagctcaccacgacccttgataaaccgctgaactatgatccaacgattctctatcagtatttggataccgtcctgagaccgggcagtcgccacgacgaaaacaacttgcgctacgtgactgatccgggctatatcggcgaaaactttaattaccaaagcgtcccgtttacttcgcacatgaccgaattcgacgagaagatggccttcgcacgcaaactggtggccgaccttaatcgtcatttatctgtcaacatcaaaccagaagatgaaactatcgaactggtctttgttgactaaagcaaccgtgttaccctcctttcctagtcgcgatgcttctctcctgatcatttgcggctaagtacccagtcaagcatgcttagttgcaataaaaatgaccgtctactttttggtagacggtcatttttgtagatgcaaagcacgaattcgcagctatgccgctttcttcgcgacttcctttggtaacgtcaacgccaacagcaagccaatcaggcccacgccagcaaacacagcgaaggtaacagcaaaaccgccagcatgacttcgcagcgtggtttgcatgccatccaacaacactgtggcgaacatgacaccggcagaaccgaataactgacgagccgtcgttgtgaccgcagtgccgtctgccacaagctcattcggcaaggcattcgcgccagccgtcactgagggcatcatcacaaaagcgttaccggcttcagtcgccatcgccaacataattgccccaatcagtggtaaatgatgggcaaagactgctaacagaccaaagccgccagtaatcaacaacatgccaatcatggccacgatacgcggtccaaagcgatccagtaggcgcccgctaattggattcaaaatactcagcaacaccgcagctggcactaaggacaagccagaaatcaacggtgacaaaccaagtagcgtttgaaagtaaagcggcatcaggatagtggtgacaatcaaaccgacgtatgaaattccggtcagaaacaccgctttagtaaacataccagtggcaaaaactcgcatttgcaacattggtggttggcgattcaattgccgaacaacgaaaataccagctgccagaacgcctaaaatcaacaaactaaccacgccaacagttaagccttttttcgacaaagcacccaaggcataaagtagaattggaaaacttgcggataaaaggaaggacacccagtccagttgcgtcggttgcaatggcatgacagacgcaatggtcaccgttgaaacggccagcacaagcagcgaaacgaccaagaagaacaagaataaagcctgccaagggaaccatgtcagcaaaaccccggaaataatcggaccgactgccaaggctgagcccatgaccaatcccgccgtgcccatcacccgaccacgctcactatgcggcgtaatcgtcagcaacacggtctggaaactcgggaaaataatcccgaccgcaatcgcttcaagcaaccggccaatcatgagcacggtaaaactcggtgcccagatacataagcctgtcccaatggcaaaaatgagttcaatcgcttggaaaagccgttggaaaggaacattatgcaacagccatggactaaccggaatcatcaaggtcatcaccaacataaagccggttgtcagccaagcaactgtatccgctcctaaaccaaaagctttcataaaagcaggataagcggtgcttaaagaagactgcgaaattgacatcgaaaaggtacctgtcagtaacgtggcgacaaaagccccgcgatgtttgatcgttggagagtgcatattaaaatcatctttttctatattagtattgtgggacgtttacattttcatccccattttttcataagactgcataccgcccatccaaatctcagatggtttgacgccacgttctttagccaaggccatcattaacgtatccatatccatcaacttatattcttgcttcggcttggctggatcaaaagtttcaatctgcgccatcatgccgccatcttcgtgttcaatgatatggcagtgatacatataaacccctggcaaatcaaagcgaaccagcagtcgaaccgtttccccgggatttacgccaacggtatctttaaatccatgttcatttggatacggcgcatgcccattccgcgacaagactaagaattgggttccatgcacatggaatggatgaaccattccaggcgcatcattgctattggtaacatcccagtactgggctttgccaattggctgcgtggcatcaatccgctgcatggcgaactttttaccgtcaatcgcaacaccttcgtccatcccctgcatcacaacatggcgaactggcaaagccggatcaaccacaggcgccttcacgtcgaacaacttatcaggcaaagttgtctgatccggtttgaacgcatgaatgcggaactttagcaatggcacatcatccgtatataaggtgacctcgtcgccttcatggtattggccaaaatcaacaatcacttcggcacgctcagcacaagtcagcatcagatgggtgaatttgaccggctccggtaacaatgagccatctccgccaatttgcgtaaatggtaggtcatcggaaaaatgcaaccgccattcacggcgattagcaccatccagaaaacgcaaccggaccttttgcgtggtgacatcaaaatagggattgattgtaccgttaatcattgcggttggcccagcaacaccgtcaggatcataatcagcccggtagtcccactggttgttctcgtgaaaacgccggtcttgcaaaatgaccggaatatcgtcaacgccatagttccttggcaatggcaggctggcttcatggtcgtctttgacaatcaccatggcagccaaaccatgccaaacctgctcggctgtggatgggcacggatgcgcgtgcagccacaaagtcgtcgccggttggtccaacgtgaagtcgatatgcttactttcacccggataaaccggcgcatggcatccgccatcaacataaggaccactgacattagccccatgccaatgaaaagtggtcaactcaggcaaggtgtttttcagtgtcacatgcgtatgctgaccacggcgatacacaatcgtctgacctaacagactggtattatagccccacgtcttggtcttcgcccctggcaacagttgtgtttccccagcctctgctgtcaccgtgtaataaacgtcggtcgctgtctctttatccggtttcaacaacggcggcacatttaagggcttctcaggcgcatcactgacatcaagcggcacgtacccgccatcgtggagatcaaacgctggctcatcaaagaaatagtccgtataggttttcatcgtgatttccccctctgacaagaattttaacactttttagggttgccataaacataatttagaattaatctaaagtagtatcgaaaaatggtataggtcttatccatacacttgaggaggattttcatgcaacaaatgtcgaaaacaatgggctggctcatgctggcgttaaatgtggtgctgctgattctaattggtaccatgcacaatatggcagcgatgtggttaatgggtctgattatgactttggacgctgtgaccgggttagttaccgcttatcggccccagtcaagtcaacaacacgcccaccagcactagtttgttaagaagttgctgcaagacctttcatggagtcattgatcagtgttatatgttgacatatacatatgttgaatatatcatgtgtctgtacttagatgaacagtcacatgaaagagggtcgtttaatgcagcaactgtcaatgacgcagaaacaaaccatgacgtcagccttacgggttgaatatttttcaacggcatggatggcatttgagttcatagtcggtttttggtccggtatgcaagcaggttccattctcttaattgcgtttggcctcgatagttttcttgaaattatttctggcagtgccctcatttggcgtcttaaaaaagaagccaatggtgcgccatctgcggaggttgctcaagcagagcaacgttccagtctcattgtcggcagtgttttattattactcagtctttatgtcattggcgtttccggctataatttggttacacatgccgcagctgatacaagttacagcggcatggcaatcgcaattgcttccgtgttcctgatgcctgttttgaccattaaaaagcggcacttgggagaaaagttaacctctcccgcgctgattgaagatggcatgtgcaacatcacctgtgcttatatggccgcgactgttctgcttggcagtttgctgacttggttgtttaactggtggtgggcggattctgtcgctgctttagtcttggtttattttgtggctagtgagggctgggaagcgttgcaaacgggattgggacacggtgatgacgcttaactaatggaggtttcggtcacatggacacagacactttagaactggtcacgacagctaaattgactgaggcggaacgcatttttaagttattgagcaatccgattcgcctacagatgttaaaactgctcgaacaacgggaactgaatgtcggtaccattggtgacttgttaggtttggaacagtcggttgtttcccaccaacttgccttgttgcgaaagcaccagctggtgagcgccaaacgggtgggtaaagccaatttctaccgcctcgatgatccgcatatcatcaccgtcatcgatgctatgctcgcccatgccgaccacgtggctcgcggcaagcgacacggcgaataatgcaacaatgggtttgcagtcggagaaggctacgagtcagccataaaaaaacgttacctttaccattttcggcaaaggtaacgttttttttaatggttcaaacgagcgtcttggtcgcgattattccgccaaaccgtcgtgaatcttatctaggttccatttcatcatgctgtagtacgtatcgcctttggtgccttttgctgccaaagagtcagtaaagattttggcgtgaatcgataagccggtttctttagcaactttgttcatggacttcggtgaaacagaactttcgacaaacaaatgcttaacatcggaggcgcgaatttttgctaaaaccgtctgcatctgctcaggcgtaccttgggcttcggtgttaatttcccagatgtaggccggggtgacgtgataagccttagagaaatacttgaaggcgccttctgatgtaacgagcaaccgctggcgttccggaatatcaaggaactgagattgggcggtttgatgcagtttttgcagcttagcaacgtattgatctgcattcatctggtaataattggcattcttggcatctttttgcttcaacaccttggtgatggttttcacgtattgaatcccgttggccagatcaagccaagcgtgcgggtcttgttccttcgtattggtcgtcaggtacatcggattaaccccgtcactggcagcaaaaacgtctttgttaaaagctttatgcgatgtttgaactaactttttgaaccaaccatttccgccagtttcaaggttgagtccattgtggaagacaacatcggcttcactagtagcagcaacgtcggtcggtcgcggttcatattcgtgcgggtcggtgccacgcttgacgatactatagagttcaatgcgatcaccgccgacattgtgcaccatgtcttcaagaatcgagttggtggtgacgacacgtaattgttggttagtacttgctgaatctttctgagtcgtactgcggttgtttacaaaccagaaaacccctgcaaccatggttaaaacagcaacaacactgattagaatctttttcatcgaacagcctcctcagcagtgtgggtagcagcagcggttttcttttctcgttgttttttactgaaactgaagaacgcctgcttcggtgagaagacgaaggaaatggcgaacaggaccgcagctacgagcacaatggccggcccggatgcccagttaaaggtgaaactgaagtaaagtccggtgatggccgagaaaacgcctacgctagcggacgtgatcaacatcgtttctaaccgatccgtccacaagaaggcagttgctgctggcgtaatcagcatcgcaacaactagaatgatcccaactgtctgcaaggctgaaacggtgacaagcgtcaacaccagcatcaaagcatagtgaatcatggtggtattcaagccatacgttttcgcaaacgtattatcaaacgaggtgatcagcagttccttatagaacagaaccacgaacaggatcacaattcccaacacgacagcggtggtgacaatgtcgctgtcgctgacggctaaaatgttaccgaacaaaatatggtgcaagttggtcgcactttcagccattgaaatcagaataaaacccaaggcatagaacgcactgaacacgaccccgatagatgtgtcggttttgattttactgttggctgccacaaatccgatcagcaaagccgcaataattccgaaaaccgatgccccgatcatgacgttaataccgagcatataagcaacggctaccccgggcaggaccgcatgggaaatcgcatcccccatcagcgacatgccgcgtaaaatgatgaaacttccgatcaagcctgacatgataccaaccatgatggcggtgatcaacgcgctttgcaggaaatcatattttcccaaagcggtaaagaattccattattgatgtcatacgcgcgcaccctcctttgccgtaaacaagacggacgacaggtcggctgaaaatgcccgttcgatattttgggcggtgtaaacttccttgaccggtccttccgcaacaatgccgtggttcatgaccacaagttcgtcaaaatattttgaaactttattcagatcatgatggaccacaatcagcgttttaccggcatcgcgccactgattcaaaatcgtcatgatctcttgttcacttttcatgtcgatccccacaaacggttcgtccatgatgataatttctgcatgttgcacaatcgcccgcgcaacgaaaacgcgttgcaattgaccacctgataactggctgatctgacgtttcttaaaatcctcaagaccgacttgggtcagggcgtcaagcgccgcctgtcgttcctttttgccaggacttttcagtaagcccaatcggccatatgtcccagtcagcacaagatcttgaacattgatcggaaacgtcagatcaagatctttacgttgctcgacataagcgattgactgctgtacctctttgagtgtccggccggaaaagtcgaccgttcctgattgtaccttgatcaatcccaaaatagctttgatcaaggtcgatttacctgctccgttaggcccaatgattccggtgatcttacctgcgttaaaatgaacggcaacatcagcaaacaccggtgtgtcagcgtaggcaacggtcaggtccttaactgttaacataagagcctccaatttttagggtgacctaattcgctttcatcttaagcttacagaaaatttcaaatgctatcaagtgttttttaaggcgaacttaaaaaagctaaagaacatgaactagtgactatcacgaatctaatgcttaaatggcttacttctcgataactgccgtagataaaagtatgtaatcgcattcattcataagcgctgagcatcatcaaaaaagagaaccatgatcgagataaatgctcgctcatggccctctggttatcgcctagttattttaagctttctgggtgacgctgtaaataaatgacatgtgtgttggtaaattcttcaacaccgtgaataccatcggcgcctccgacaccagattgtttccaaccagcatggaagccttggatgccttcaaagttgaatcggttaatgtaggtctcgccaaactcaatctcgttagcaacatacgaagcggtttccagatcacgcgtataaacggagctggtcaggccatataccgtgtcattcgccatttcgattgcttctggaatgctcttgaatgtcaaaatcggtaacaccggtccgaagatctcattttgcacaatctctgaatcctgcgcgacattggtaatcacagttggttcgtagaagaaaccaccgtcaatgtcagctgggtgaccacctgtttgaatctggccgcctgcttcaaccgctcgctgaaccaaaccgtccactttatcaagggcgccttgattgatcaacggacccatttcggcatctgggtcagtattcggattaccgactttcactgccgccatctttgccgtcattttcttaataaactcatccgcaacatcttcttgcacataaatccgttcagcgttgttacaaatttgcccattgttatcaattcgcgagtcaaaaatggcctgcacagctaaatcgatatcagcatccttagcaacaattgccggtgccttcccaccaagttccaatgacatctttgccacgtgattcgccgcagctgccatgaccttcttaccggacgcggtggacccagtcaggctgataatgccgactttggggttcttcgccaaatcatccccaatgatggacccgcgaccactcacaaagttggctacccctgccggcaaaccgacttcatcaaccagttttgcaaatgccaacgccagtcctggggtgtccgaacttggtttgatcacgatggtattgccggttaccaaagctggccccattttccgagcaatcaggaagaacgggaagttccaagcaataataccaaccgcaacaccgattggctgacgggcaatgataatattttcgttttcattgtcagattgcatcacatcgccggaataaacgcgtgcggcgttggccatatagtcaaaataatccgccgaaaactcaatttcggttttcgctaaggcatgaatttttccttgctccaacatcagaatcttcaccagttcatcttcatgctcacgcactaaagtagcaagcttgcgcaagtacgcaccacgcgttggagcaggcacgcgccgccaagcattcttagccgcccaagcagcatccacggctgcgcgggcttcctcaattgtcgctgccggtgctgtccacaatttcttgcctgtggaaggatcgatcacagtttcaacatcgcctgatgccgaatccatgaacttgccattgatatacatctgatagtgcgttgactgcaattcagccattgtgtttttcctccttgcaaacgtcttttctgtccgacgaacatcagcaaagccactttgctcatgttatgtaagcgctaacttcatacatcttaagtataacgtcatattcaggcaaaagacatgataattgcttgtgagttagcaaacatgaggaaataaaaaacacaaaacgaattcatcgccggtggcttcaggtttcaccaactggctttccgcaccccaggaatttggcctttatgggcgagttcacggaaattaagccgggacatgccaaacttccgcatataagcatgcggtcgcccatccaaaacgtcacgatgatgtaaacgaactgggcttgaatcacgggggagtttgcttagaccaatatagtcacctttcgcttttaatgcagcgcgttttgccgcgtattgttgaacaagtttttcttgtcgttttgcttttgcaattttagatttttttgccaaaagaatgcctctttccttcactgatggtctttaatctcccgcaaacgagtcactcaaagtattcaaatgaccaccaattattgatacattaccgatttttctgttgcttacgcttagcatcgtgcaaaacttttaacgcccgttttcgggtcttaatgttgggactcttcatacgccgccgtgcactggcaagatctgtcttttccaaaaatgatcacctctttttaattcgtaatcattactatttaagcaacggcagtaaccgtatcacgactgcgatttatctgtcaattagaatttaagaacgtcacttttctcaaattttttgaaaattttccttgccagaccgctcactttgctttatggtttaaatcgtaattattacgttttggaaggaagcgggaatttatgatgaagcgattacttgcaggtatcagtgtcgcattgctggcaatttttgcagtcgcatgcggtagtaacggtgccgcaaagcaatccagctcgaatggcagcaagattcaagttgttgccagtcttgatttttatggtgaggttgccaaagctgtgggtggtaacaaggtgtcggtgcagtcgattatcaacaatccggcggttgatccccatgactatgagcctactaccaaagttgggaaatcagttgcgtctgccgatcttgttgtcgctagtggcattggttacgacggctggatggataaggtcgtgaaatcagcggacaaatccaaaaattacttacgtgtcgctgacgatttgatgaacaaaaaggaaggcgacaacgaacatatctggtacgatccgcgaaccatgccaaaactggccaatacgttagctgataagtttgccaagaaagatccagctgacaaagcgaccttcaaggcgaatgcaaaaaaatacatcgcttcactggacgatctcaatactttgatcaacaagttgaagtcgaaagtaaatggccaactcgttgatgtctccgaacctgtctttggctacgcgctcgattatctgggctacaaagtcaatgacgatcacttctcgaagtcaaccgaagacggcacagactacagcgcaaaagatatccatggtatcgaaaccgatattaaggaaaagaaaattgccttctttgtcaataacatccaagcaagctcaaagactgtcaatcaactcgtcaaattagctgaacaaaataatgtgccggttttgaaagtgaccgagacattacctaagggcaaaaactatcggacttggatgaccagccaataccagcaacttgaaaaaattcaggatcaagcaacgaacagcgcaaaatagcatcacttctggtcacaggggtttatcattcccccaatgtttcggcaaagctcaccctctgtcgaagtttcgttaattgctttgatgacaagataaaccatatgcccgggccaacaacaccggacagcacttgaccagaaggaagcccgcgaagaaattcgcgggcttttttgatcgttccgcccacaaataccggtgttacaataaaactgtattgggaacaagaaaggaagattcaaatggcaaatgtcatgatcttaggcgcacacgggcaaattgcaacgttggcgcggcatcagttgctgaaagaaaccgatcatcacctgagtttgtttctacgcaatgccggacggctgcaagacgtcaatccgcaacgggagacggtgattgacggggatgtcaccgacaccgccaagttgaccaaggcgcttgctggcattgacgttgtctatgccaaccttggcaacaagggaattgaagatcaggcaaaatccgtcgtgaaagcgatggatgctgcaggtgtgagtcgattgatttggatttcgacgttgggaatttacgatgaagtccccggcgcttttggcaagtggaatcatcaaatgcttgatggtggttatcttgaaacctacgccgcagccgccaaagtcattgaaaattctgacttaaaatatacgatcattcggccagcttggctttccaataaaaacattgtcagttatgaattaacggaaaaaggcgagccatttaagggcacagaagtctcccggcgcagcatcgctgacttcgtcgtcaagctgattaacgatccaagcaaacacatcggtgcttcacttggcgttgaccaacctaacacccaaggcgataagccttccttctattaaagtaaccagtcatcggccaaatcaaaaagagtttatttccgtgttcatcactgggaaataaactcttttctgttgccatgccctttacttggctatcaaagcattatctttttaaactcaatcaaactttgtcatccagtgactagccgtatgtgcgtcaaatgccatctcaatgtcggccggcaaattgcgttgtagcgataagggcacctgaagcgcttgttctcgcgtaaaaagttgaacctttgcagtttcgatcccgctttttaacgcacgattctccggtagacaagcaatgaacattttgtacacatcttgcgaactttgcttggcataggcgtgcttacgtagtgcccgaactgccagtaattgttgcggtttcacggttaagccggcctcttcacgggtttcttttacagcaatttcacccgcactataacccaaatccgcccaaccaccggggatggaccatgtaccgcccgctcgttcctgaaccagcaatagttgatcgtcaataaaggtaaccgcacgaacatcaactttgggcgtcacatagccaaaatccgcatcgacaaacagctttgcttgctggtcactggcaccaagctttattgccagcttagtcgtcacgtcagccagttctgtataacgctgctgatcaaaaacatcctttgcgtaatagttacccgtctgtgcaattgcctgcaacttggccagcaaagtattcaaatcatcttgatagggtgccaaacgatcgcctcctcacgtccaacctaacaaatcagcgcgccatcacctatcacaaccccgtcgatttgaaaaagtcttacgtttcaggtcgcctgacgctgtgtaacaaaaaaagcagtcatcaactgccttttgcgatcctatgtaacttgattgttacttcgagcttccgctatttgtcaccgcttgctgattgttcgcatagttgcgcacggattccggaacttgaccgccgaaagactgttgaccaatactgacggcctgcttaaagaaagcttgagcgcttgactgatagccttttccatcattgttaataacggctgtcaacacgtcacttgattgcttggcataatcaaccaatgtctttgccaaagcatcatcccctgaatcctgtgacttgttattatccaattccagccggatcttatcaagtttagagagactggctttagccgactgactgagggttttgttatcactttgcagtgagacctctgtcatcgttttcatcaccaagtcagaaatggtcgtataccgtttctgcaaagtctgcttggtaaaatggttcaccttaatcatcgtcgacccagtcgagctagacgactttgaactttttgactgacaaccagttacaccgatcatagccatcactgatactgcaataacaagccaccttcgcaacttgatccctccccaacatgatgacgaataaccgcatcattaaattaattcaaacataagccgttcgagacgtcaaacatttcaccagttatttgatccctttaaccaaataagctaagcatcattgttcgttatttttgtaagtattatctcacaaaaatcgccttactaagcaagggaatattcattatatttgttaatccgaataaatatccttatgttataattattttgttaaattatgactaaggaagtgccgagatgcaaaagcgccgccactcacaaaagcgtgcttcagtctttttacttatcaccttgttgctgtcagttctggttgccttaatcccaccgctcataagcaagccgatcagtgtcggtgctggccagaatatcgcggtcaccggttttggtagtcaagatgctacgattactgacaccactgggaaagatttcacccacgcacccaatctttcgatgtatagcgtgtacacattaacctatcactggcgaattcctgacgaagtggtcgtcaaagccggtgataccgcgacagtttccctgccagcaacagttgtatcgcgagccgatgtggactttgcagtggttgatcccacaactggcgccacgattggccatttcttttccaaagcaggtagttcaaccggtattttgaccttcacggacttcttcagccattcaacagtcggccgccaaggtgagcttcaattcatggtaagtggccgctatgatgatagtggtcatcaacgtccaggatggtatatctacaaagccgggtgggttgtcaatccgccaacaggtgcaactccagaagaaaaagcgcagtatgttgatgaccttggtcgacccaaaattttccagtgggagattacgattaatccaaatatggagcatgtcgacaatgtggtgctcactgatacacttggtcccgggcagcattttgatacaagtcgtgggctggtcgtccacactggtacttacgatgacaactggttccatgctaccggtaccatcaccccaagctatcaagtgaatggtaaccaagtcaaaatatcgctgggaacgatcacaaccgccatccaaattgatttgtggactaatcccacctctgcaagtttcgaaaccacagattcttggacgaattcagtcgttgcttcaggcaagcaaggcggtagcggtgctccagcgcaagcaaacggcacaatcacttggcgtaacggcggtagtggcaccggccaagttggacaggtcacgctaattaaacaagaccaaaaaacacatcagcaggctctcgccggcgctgttttctcactctatcgtgccgatggaaccttggtgcacgacgacctcatcactgatacgaagggcaagttaacctttacccaactcttagtcggccaatactattttgtcgaaacaaaggcgcctaaaggatacaagctgaatgcgactcacttgccgtttaccattacccttgataaaccgcaagtgacggtcaaggcctatgacgagaacctgacgccgccaccggtaacgccgtcgacgccatcttctgaatcttccagttccaaaccgtctgtaccttctagctcggtgacaccgccgtctaaaccatcaacaccttctagttcagtgacaccgccgtctaaaccatcaacaccttctagctcggtgacaccgccgtctaaaccgtcgtcaccttctagctcagtgacgccgccatctaaaccatcaacaccttctagctcggtgacaccgccgtctaaaccgtcgtcaccttctagctcagtgacgccgccatctaaaccatcaacaccttctagctcggtgacaccgccgtctaaaccgtcgtcaccttctagctcagtaacgccgccgtctaaaccgtcgtcgtcatctagcgagccttcaaagccggctgcttcatcaacccctagccatcaggaaagctcatcttccgtatctagcagtgatgtgatcccttcatcctcttcagaaagcgattcttccgcaagcgtggaggttgtcacgccaagccacaacaacacccatcatctacctgacacaggtgagcgtgttttaggctggctagccattgcaataggaagtcttttatcaattactggtatccttctattgattaaagattatcaataagcgcgtttcaaaaactgcagcatgacgatgaaatgaagccatcgcctgctgcagttttttgctgctttaaattttgcttgcgtgtacgccatgaatacgctacgcttacaaccgtaaccattacgctttccaacaaaggagcttttgcccatgttcaaacgattattgaccgccttcagcgtcatgttgttggcaatccttgcagtcgcttgcagcaccagcaccaaatctggcagcaaccaaaagattcgagttgtggctaccgtcgatttttacggtgaagtagctaaagcagtcggcggcgatcaggtaagtgtccaatcgatcatcgacaatcccgccattgatccccatgactacgaacccaccactaaagtcggtaaacaagtggccaccgccaacctcatcgttgccagtggtatcggctatgatggctggatggacaaactcgtgaaatccgaaagcaagtccaaacaatacttacgtgtggccgatgacctcatgggcaaacacgaaggcgataacgaacatatttggtatgacccacgcaccatgcctaaacttgccaatgccttggcagacaagtttgccaaacaggacccatccaaaaaggccatcttcaaagccaacgccaagaagtacattgcctcactcgataacctcaatgctttgattcagaaactcaagcaaaacgttcacgatcaaaaagtcgacgtctccgaacctgtcttcggctacgcgctggactatctaggctacaaggttaacaacacccacttcgcccaagctaccgaagaaggcaccgattatagtgccaaagacatcaacggtgttcaagacgatattaaagaaaagaaaatcgcctttttcgtgaacaacagccaagccagctcgaaaatcgtcgacggtctcgtcaaattagctaagcaacacgatgtccctgtgctcaacgtctccgaaaccctgccaaagggcaaaaattatcgcacttggatgaccggccaataccaacagttagaaaaaatccaagcaaaggccgacaaaacaaactagtctctctgtcctaccacaaaaaaaccacttcgtcttcaaatatcgcaacttgcatcaacggatacctctctaaaagaaggtaaaaaatgcatggcctgctgttcattttgtgacaactgacatcttttcgtaaaatttttgcaatgaattcgttttcaaaagccctataccaattgaagttttgcttggcgactcttacaatgtagttgtaaacaggaacaactaataggggagatgttttaaatgtcactgatcaagcatacttttaaacgcgttgagcacatgatcgcagcaccacgcgatccccacgaagaagaacaagcccgtcttcaagaaaacctgttctatacgaacctcagtagtctgcaaccaaaaacgaacgctaagttttgattgaatagatatgaagtgaatgaccgcctcaacggcatgttgagacggttttttaatgccgtccatttggctttaagaatcaaaatgaccaccttgaggagcaaatactcctcaaggtggtcaaaaaaactttcaggttatgttgttgagcctgtgacggctatgccaactgttttagctttcctaagttgttttcatacggttttctggcggtttaaaccacctccctgttgatacagacctttgtgctgccttctcatggttagtgcaatcccaacatcaactcaaccatgaagacttgtatgctctcttttcgagacatcacaatcatgaccgccactaaggccttcaaaacgcttttaaaccatccgatggtgtttacccacttctgtacctcaagccatactaaattaatagcaggcaactcaatccaaggattgcacatatcaagccgctctcgctcccaaagcgaaaacacgtgtgatgatcaaagagcaacttacatctcaatgaagaatgctctctaatcaaaccaaatagcagctgcagtgacatctgagccatcatcccatgtgatagtccagctgctagtgtaaacagctcattactttgcgtgacgatacttgcgaactccggccaagccaagaaccgcaatcacaacagcaccggcctcagccaaaattgcgcccgcttggctttcaccagttgcaggataggcatgtttgccattcttttgagcaacccgactcatcggctgactacttgaagactgtgcggcaacaactggaataacagcagcactggaagtcttcgggttagccgcactcgatgcagacgaactggcagcacttgacgctgctgaactgcccgcactcgatgcagatgaactggcagcacttgacgctgctgaactgcccgcacttgaggctgacgaactggcagcacttgacgctgctgaactgcccgcactggatgctgacgaactggcagcgcttgatgctgctgaactacctgcactcgatgcagacgagctagcagcgcttgatgctgctgaactgcccgcactggatgctgacgaactggcagcgcttgatgctgctgaactacctgcactcgatgcagacgagctagcagcgcttgatgctgctgaactgcccgcgctcgatgcagatgaactggcagcactggatgaagctgaactgcccgcactcgatgcagatgaactagcagcacttgaagacgatgaactggtggcactggatgcacccgatgatgaggcaccactagaaggcgttgacggcttaggaccgggattcaacgcttcaacctgtttagttaatgcagcaataaatgaagccaaggcactttcttgttgcgcattgaaagcttgaaccttagtgttattgtctttttccgcttgtgcttcttgactggcaaactgatcagccagttgctgaactgcgttgttcaaggataacttttgagtttgatatgtttggtcttgactgttcttgagactctgaagattatcttttacggtttgaatcttctggtcaatttctttgttattgtcttggccggtagaaggtgttgatgtttgtgctggaaccgttgcaatgtttacaccatcatactgatgataagaaccatttgagttcatcacccaaacattatcggttgtgttgtattgaagtgagaatcctgtttcaacatctccgcctagaagaatattacgatgaccattatcgctgtctccatcatagttgattaacccattaattgagtctgcaacaccttggaacacttctaacatcgtctcatgagctttgctatacatagtggctgcttaaaaattctataattcaggcagttaagctaatatatgcattattgcggtataataaatccattggaattagctgttttcctgcattttccttgcattttttgggaacctactcggaggttatcgtatggtctatcgtcacagcccacttcaattgtcatttgaatcctttggtgccggtttaagtaccccacttagctctaacaatgagtgggtccagttggcggaggtcatgccctggaaagctctcgatgaggcataccaattggagttcaccaaaaatgcgggacgtgcggcaaaaccatttcgtttactctatggggcaatcctgatccaacaacggatgggtttaactgatcgtggggtggttgcggcaattcgtgatacacccgcacttcaatatttcatcgggttgtccgaatacaaagcggttgagccgttcaattattccagcctggcacactttcgcaaacgaattgccgatatctccgagctgattacgaatatcatgaatgatacagtacgcgccaagatcgaagcgttggtcccattcaaagtggacaccgtcatcacggacgcaaccgcagtgccagtcaaaatcaagtatcctcaagacaccgtcctcctcaaccaagcaaggctgaatcttgaggcgatggcgatcgatatggcacaccaacttggtgtgccaaacccacgcatgtacaaacgcgaggcgaagcattgttggacctcattttcacgacatccaaagcaacagcgtggtggctttcataaacaggtcaaggcccaacttcaatatgtgcgccgtgatttgcggtacatcaacgaattcatcgatcagggtgcgactctaccagatgaacaagcgattcgcttaggcgtgattcgaattctatttgaccagcaatggtacatgtatacccacaagactcaccacgttgaagaccgaattgttagtctccaacagccgtacattcgcccaattcaacgtggtaaggccaatgctaaagttgaatttggggcgaagattgactgttcgttaagtgaaggcgtagtcgacattgaacgttttaatttcaccgcattctctgagggccaagacttcgcggaaactttagaccactattacgaccttcatggacattatccggatgaagtactggccgatacgctgtaccgtaatcgggagaacctaaagctgtgtaaggatttgggtatccgaatctgcggtccgaagcttggccggcatccaaaacacgttgatgcagcgaaacggcgtgaggatactgatgccgagaatcgaagaggtaccattgaacgccggtttgcttttatgaagggcacgctggggcttgacttggtgaacactcggacagctgaatcactggccgtcaagattgacgcggccatcgtcttgagcaatgtgctgaccctgttaagggtatttgctataccaattttaattttggctaaattcgagggtgaggcctatcaaattcgctataaatttactacaagggtcgaagatatggtggcctagttcaacagccactacatagtatatgaggaaaaatcaacagaagttagtgtttcatcaacatctcgaccaaaaatttgagatgttaaatcaggattatgaagcatatgaccacttttaagactatctccacgctgttgaaccttattaagaaagtcctgtgttgttgaaattggtgttagacccatagccttacgataattattaacaagcatcatggcatattgatttaactcattcttttgagcgtcagtcaattgattattattaacaacatctcctaaagaccaagatggaatattctcgttgaattgaacgtaaagattatccatcataccagcagcatttgggtctttgaacaccggaagattctgcacaagataattaccgttccaagtcttatcagaatccctatgagtaacaacattagtccaaaggccattctttgctacataatcaaatgtcccaccgtcactgacagtatcggccggttgaccagaagtccgttgggcgttcaatgaatcaatttgcgtatttgcagactgactagcggctgcataagatgacgcttgctgtgattgtaatgctgctaagctacttgctgcacttgaactagcagctgccaaagaagcttgatcttgttgtttttgcgctgcagcttggcttgctaagctgttggcataagaagcttctgcttcactggtcttttgcttttcagcagcttcagagacagctgcgtctgatttggcttgatcatattttgcttgttgtgcctgccattctgcttcggtcatgcctgatgaagctggcatgctggtgttggcattggcggcttgacttgctgcttgataggccgcagttgcttgttgttgtgcagctgccggactggcctcaccgttggctttagcggcgttggctgttgctacaggttgggtgtttttaacagcacttgcaggttcagtttgtgctgccgccggttgactcacttgtccgtcttgggtgagtgtcactggctgaacgacaaggtgcgtgtctgtttctgcagcattgacaggttgaagttgcgtcaaggcgacaccacctaacgctaaggcaaatgcggaaactacgccccactggctgccgcgtttgtacatcttttttctatcattaacaacatgttctttaacccggttatataacatgttacttcctccaataccattaaaattatgtcttttgattcggggcacaaatttcattatatatatttattaggtatattatgcctaggcaacctgttactagcctttcgttgctggcgttaccgatattgtgccaaaacgggcatctgcaccaaaatggccttgatccattggttattctctagtaatcgttgcatgtcgaaatggtgtcacaaaagtgtctttaaagtcacctgtcccttggatcttttcaaggttacggtcactgattgacgcgctttgtgcacttacatactgccaaaagaaatcttgttcaaatgcttgtaacaatgacgcaacagttgatcctttatccttcaagcttgctggcagaatgtcccatctttgtgtcagaaacacttgtagtgctggttgccaccaattcttatagctgcggagaacaaatgttggtgccggaatacgatttggctcgtcaagatattgacgaatccgctcgatgacacttgctaaaataaattgtgtggacggtaataacgcaacctgcgcgccacttggtagtgctttgaatgacttttgcttatttgtcgccagttgataagcttccacactctttgcttgataactcgaagtgcttttaatttgtataaacttgataaagtcatctgcattttgcgttcgataagggactaaatcgataaattgaattggatagtgacttaaaatttgctttgcttcgctaacgggcatcgttgtgttagatttttcatctgcatcaaacaaggcccgaagcaacatcgaagtgtgctgcgcataccaatgctgtttatctcgctttgtgttctgtctcagatagtccgttagcgtcatgtcgccagtatctgttttgtttggtcggaagagctgttgataaataatattgttggctggcttaccatctatccattctgcatcctcctcatgcacatatttttgaatgttgacgaagccaccctctctttctgcacgaatcaattcctcaacttgtccagatgctaccgctggattaatgttcgcgatgtaaatctgtgccttctgcggatcatgttcaatcggtccagcagggacaccatcataaatcgttgtttcggtttcattaaaattagctcttgcttgtggcttatggatatattgcgcatctgcttcaaatagccagttgaaggatagttcctctgccattgcttcttcttctttcaatttctcgtattcagcaatcttcttttcaagctcaggccgccattggcctttattttcggtattcggttctcgatatggattcaaatttgctagcaggtctcgccagctctgttcgtcttgttttgtcatagaatcccctccattcatctaggtaaaataactatagtattttaaatgggcatattgcgcctatctaaacccgattaaaaaatttcaccggcaaaaaaggagactgctgaacaggtaacgattttcttgcggtttatgataaaaagtccggcagaatctgatttgacgtcagattttcccggacttttgtcgtatcagggttttccaccctcttacttttcgctcattattttcataattcgttccatattggcataaaagagcgtcatggcctcaatgctattagaccagcttattgatagctatgtttggttttgacttctgcattcttcgcgtcaattcgataccgtaacttgatgatgtcttgaaatgcttgagttgcctgaaaggtcctctgatcttgatgtgtttaagacttaatcgtgacgctataattttttgtctttgcgcctggttgataacacccttgctgccgtggacattcatgacaatgatgcgtgtcaaagtaataagtccggccttgatcgcagctcttatcttttttaccgttcctcgtgactcgcgagtccataaaatctgaagggcaaacaaacataccggcatctttgttgaagttccaagtctggactggagtccttgatccgttgagatgattagatagagctttgaatataactgaaagtgatcacgcttggcaagtttcagttttttccccagacgaggcgatgttaccggtcattttttcaaccctcacaacattttttctattttgattaactaggctttccagaaactgcccatcacattttgacataagagtggcagctcgtttcagttcagtggctgtcaatcaataaattgatgcgactaacaattagcactatgacatccttaaaaataaccgccatgaaatgcaggtttaacgctgctttttagataagtcttgaaaaatttcgacgtttatcggtaattgtacggcgttttaaaaataataacaaaaagctcgacatttcgtgtacattgtttgtaggaagctagccccctgtgttgtgagcattatgtcgaaaacaaacacgaggtgatttgtctaacattcaattattaacgaatactgaactctgcaaggtaaacggtggtagtaacgctcttgactgtgctgcaggagtcggtgctagcccacgaaggagactgattttttgaaaactctttccaagattgctcatatcgtcagtgccttgtcaggcgttattttagtcatcaccatcatttccattccaaaatacgacagtatggcactgaatgtgtttattctgacagtctcagcaacaatgattattgataactatagtcgagaatactaagacaaatttttaataaagttccattctctcagaatttcacaaattaaataccttgccactaacaacagcctctactttgcagcaattcgcaagcaaaacagaggctgttattttgcgggaaaagtgtaccttctgtctcaaacacatgtatggccatgctttggttttctgttgttaacgaaagaaaagatgtgcgatggcactttttattgataaggtgaagtctcgcaaaattttcggctcacgcgacaacccaacaatgaggttgatatcattttgtctagcgacaccgttgaccaagacgtgatacctttaggggcttctactggaaaaaaagaagctgttaaactgcactatagcggtgatcggctggcacacttgccagttaggcaaaaagtatccctgaagtcatcatccccacaaccaccgctaccatccccgctaccaccgtgccaacataataaaagatcgccattgaccactgccgatttttaatcaggataaacacgtctgccatgaacgttgaaaaggtcgtaaagccgccgcaaaaaccgggcagtaggaacagtcgaaacgctgagagcgttggtaagccaactaaaagtcctgccagcaatgaacccagcacattgatgagtagcgtcgccaacggcttgccgggccagagcattttccctaatacggttataccgtaccggcaaacagcgccgaggccggctccgataccaattaagatcaccattgttttttgtcccttcttccaacgagtttcgaggccaagaatccggctgttgctgctagcagcccgcccagcagattgagcatcaacagtagtgtggcataaatcgcatgccttggtgccaaggtcgcaaagtccagcatgagcgtggagaatgtcgtgaaaccaccgatgacacctgttccgagggcaagcaacagccattcggggagatcgaatttcatatccaatccataagtggtgaaggccagtaaaaagctgccgattaagttcacaatggttgtccccatcatggttgtgccatcgtgggtcacgccactgatgacatatcgcaaaatgccaccaataaaaccgccagcaaagacggccaacaaccaactaacatgtattttttcacgatgctgcatcatgatctcctttcgtgggaacgcactagctgacgcagaaacctctgcataaacatatcaggctaagatctgtcactttgtcctgaggccatttatgctgcaatttttaaacgcaccagctcatactcaaaaaaaagacacctaccccgatttgctcaaggtaggtgtcatcaacttgcgtataggcgaacaccatcgccatttaatttattgaaagtatagcaaatgtttggtccgaacatcaacaacaatgaacgtggtttgtgcatatcttgacacacacaaaacgagttgttattttgttcgtatatacgtgatatattaaaacaatgcgtagataagaacattctcctgaaatctaattggtctctcaatggtaatgggttcatcctagtcgcacttacaagccaactgatgatcgctttttcacatcaacagccgcgctactgctggatcaagttcaattagttgcactgcacaagtatattgaccgcttcacgacctctaaggtataattaaggagttgaaaagaggccaccgggcggcttcccgatgacctcgacgcagttcagatgacgatttggtaaaagctaatccttgaggttagcttttttgatgatcgcgtacgctttggccatactggtaatcagtatgctaagcgcgacgataatcgacgccacatccatcgcggcgaacccctttcgtctcctgattttggcatggctatcacctccgcacttcaaaaaatgttgaggggtgtgtgccatccaacctgctggacaaagaaaaagggtaattagtcctctctctaagcttgctttcagtctataggttttcccgaatgcggtcaataagaaaaattggtctttcgcactcaagttaatcttcctcttgcacccaaaaagaaaaaagcgtacgctctattcgtatagaataacaggcgatgatgttcgccgcaaatgattgtgtaacaatctgatgacgtctactgaaacgacttttatgtcgcttcggtaggcgtttttttcgttgttaccgaaaggggaaatagacatggcaatttttattgatacggtaaaggctcgagaaattttcgactcacgcggcaacccaacagtggaggctgatgtcgttttatctgatggcacctttggtcgagccgaggtgccttcaggagcttctactggtgaaaaagaagcggttgagttgcgcgatggcggtgatcgactgggcggtaaaggtgtgctgaaggcggtcaatcatgtcaacacggctattaatcaagccttgcatggtgtttcgccttttaatcaggctcacgttgatcagatcatgattgatttggacggcaccccgaacaaggccaagcttggcgcaaatgctattcttggcgtctcaatggccacggctcgggccgctgccttggccacccatcagccactttatcgttatctaggcgggacagatctagagttaccacaaaccttccacaatgtgatcaacggcggtgaacatgccgataatggtattgatattcaggagtttatgatcaccccagttgaacgcacgtctttccgtgatggctttgagaaaattacgaacacctatcacaccttgaaaaaagtcatcgagaaggccggttacacgactgggttgggtgacgaaggtggctttgcccctgacttgaagaattccgaagatgctttgcaaatgctacatgacgcgattattcaagccggctacacccccggtaaggaaattgcgattgcttttgatgcggcggcttcttacttctacaaccacgacaccaaaaattacgactttgaaggcaaaacctacacgccagaataacttggtgcttactacatcaagctgcttgatcaatttcctgaaattatttcgattgaagatccttacggagaagacgactggggtaactttgccaaatttaccgccaagtacggcaaacgcatccagatcgtggctgacgatccagtctgcaccaacccgaagttgatcacggaggctattcaaaaaggcatggctaattcgattctgattaagctcaatcaaatcggtactgttactgaaaccctcgaagcgattcgcttagcccgtaaaaacggctacaccacgatgatgtcccaccgctctggcgaaactggcgacacctttgttgctgacttcaccgttgccaccaacgccgcccaacttaaagccggcgccccagcccggtctgagcgcgtcgagaagtacaaccagttgctgcggattgaagaagaactcggaagtgacggcacgcgactggcacactttccagatagtgttcaattcgactaagtttgcagagcgtgaactggcgcgattagaaaccggagcataagcgggcacaagtgcgatggccgggctttggccattgtgcttgtggtccttatgtgcaggtttctgcgccggtgaacgtgtttagaacatgaactggcccggttagaaaccggagcataagcaatgacgagaccgagcgtttaacgacgatcgatctttttttctgaaaggatgtcgatgaaatgactcaatatggcggtctttcacaatctgaagcaactgcacgtttacattcagatggtttcaatgaggttaaaaagcccaccgtcagttttattcaaggcgtactcgcgcgtctgtgggaaccttccgcctggattttggaggcagctttagttgtcgaaatcgttcttggtaaaggtattcaggcaggttttattgtgctgatgttgctgtttgcggctgtgaatggcgcgattcaatcaacgcgggctcgggtggttttacgcaatctgtcacatgaattgaccccgcttgtggccgtgaaacgttctgacaagtgggtcacaaaacccgcaaaagagttggtcgtcggcgatttaattagtctgcgtcaaggagatatcatccccgctgatgcccgccttctggacaacgcggttcaagtcaacgaaagtagtatcactggcgaagctgcctcggttcatcggcaggtcaatcaaactgtttatgctggaaccgaagtactgactggacacacgcttgctgtcgtgacagcaattggtgcagacagtcgttcagggaaaacgatcaccctgctcaaccaatcagccgcacccggtcacttgcagcaactgctcggtcgaatcatcaacgaccttgcgattctcgatagtgtgctagccatcattctgatcgttgccgctttaattcgtggtgaaaacttgatcagcatgtttccctttttggccatgttgttcattgcaacgatcccaattgccatgccttccagctttgcggtggcaaattcagttgaagcaaaagtgcttagtcgtgaccatgttttagttagtgatctgtctggcattcaagaagcggctaatcttgacgtgttattggttgataaaaccgtcaccatcactgaaaacaagcctgtcgttgtgacgtttacaaatctgtcggatctgcctgacgaaaccgtacgagcttacagtgcttttgcttgtgaccaacaacaccctagtgtcatcgatcaagctattttgacattcactagtaacaatcatgttgaagcaaccctgagcaacttcacaccgtttactgccgaaactggctatgcaagtgcaaccatcacaattgctgatcgtttgctgaaagttcgtcttggctctttaaaagtgctacagtcacgtgatcctgaatcaccaaaactaccacccctagccttagatgcaggccgctcagtcgctgtctcaattaatgagcaccttgttggcgtctacattcttgaagacactattcgggccgatagtaggcaagccattgaagctattaaaaaccgcggtgtgcagctggtcatgctcactggcgataatgtcaaaacggctcagaccattgctttgaaagccggtttgaccggtcaaatcgtagccttttcacaattacccgccaccttttctttgcagaatctagctggcattgccgaggtaaaaccggaggacaaactagctatcgtccagcgattgcaagccagtggacacatcgttggaatgaccggagatggcgtgaacgatgcccctgctatcaggcaagctgaagtcggcattgcagttgagaatgccgtggatttagccaagcgagcagctaaaatgattttgcttgaacccggtttaacctccattattgagattcttgatagcggtcatcgcgtttatcagcgcatgatgacgtggaccatcaccaagttatcgcgaaccgccgaactgacgatcatcctaacgctaggttatttactgaatcattttctgccgttgtcattaaacgcgatgatccttgttgccatcttaaatgatctcgtgacattggtacttggtactgatcgcaccagcatctcccaccatcctgaaaactggcacttaggcaaactcggttttatcagcggcacactcgcaatcggctggacgctcgttgggatgatcatcttgacgctgctcaccaaccttcacgtagctcaaggtcagataagcaccatcattttcaactatctgatcttcagtgccatgctgaccatcctgatcacccgcagcaatcgcaacttttggcgcagcaaaccaagccgcgctgttatgacggcgatcacgattaatatcgtcctcacaatcaccctttcattactcggctggggcattgtggctattcgggcaacaacaattttggctgttctagccatcacgctggtaacaggtgtgctattaactaggatgcggcgacttctctaatattgttttccaaacagaataaaaaagtaataacagtgcagttagtctaatgaattttatataatttacgttatttttcgttacgatccgggcaccggaattttcaaaaaatcagaaatgttgtatcgggttaacctcagtatcgttctgcaccagactaaatccaagtataacggtcatcaaaaagcaggccatttgtgtaaaaaccgaacgaaatgtataaaatgtaaaattattgtaaagttattgattcggatattataaaaaagtatgatttgaatgttcaagtgacttgttcgtctcagttcactcttttgcgtcgccgagacaagcaaggttctgcttacaaatgattgattctacttttatggaggaaaactgatgaagttctggaaaaaaattgcagtggctgggatggcaaccattgctgcgttatcgctggctgcttgtggtagtaagagtagttctagcagcacaagtacaagcaatagttacacccccaagtcattaaatattcagtttgtaccatcaagcaacgccaatacaatcgaagcaaaagcaaaacctctggctagtttgctgaagaaagagcttggcatccctgtcaaagtcaccgtttcgacagactacaactcaattgtcgaagctatgaagagtaaacaagtcgatgttgggttcttaccacctgatggttacgttcaggcacacgcgcaaaaggcagccgacgttttgttgatggcgcaacgatttgggatcaaacagccaggtgggaaaagcaccgacaaactggttgattcatatcgttcgatgattgttgttaaaaaaggcagtagcatcaaatcttggaaagatctcaagaataaaaaaattgccgttcaagatgttaccagttccgctggctatatttggccgattgccgaactgtcccaaaagggtctcgacattgttaaacaagataccttggttactgtcaaaggtcacgatcaaggtgtcatgtcagtgctaaacggtgataccgatgccgcctttgtttttgaggatgcccgcaatattgtcaaaaaagatgtccctgacattatggacaaggttgaacccatctacttcacaaagccaattcctaatgacacgatttccgtacgtcaggacatgagtgccgccttccgcaaaaagcttagcaaggctttcatcgacattgctaagacaaaagaaggtcatgcgattatctcaagtatttatacacatgagggctatgtcaaaaccacagatagtgccttcaacattgtgcgtaagtatgacaaaattgccactggtgaatcaaaaagcaagtaaagcaacgttgcaaaagcgctagccacctagcgcttttgctatacatggaggaagtttgcatgtcagaaagtaaccacccagttatcgagtttgaccacgtctcaaaaatctatcctaacggtgtcgtaggccttaaagacatcgatttaaccattaatcaaggcgaatttgtggttgtcgttggcttgtcaggagccgggaaaagtacactgatgcgggccatcaatcggcttcacgacatctctgaaggcgatgtacgtattgatggtgtttccattaccaaagcaaaaggcaagaaactattgaatattcgtcggaaaatcgggatgatttttcaaagttttaacctagtcaaccgatcgtcagtcttgaagaatgttttaactggacgagtcggctattatccaacttggaaaatggtactaggtttattttccgctgaagacaagcaacgtgcttacgatgccttgcggacagtagaattggaagataaagtttatacccgtgccgaccaactttccggtggtcaacagcaacgcgtggcgattgcacgtgcccttacgcaaaccccaacgattattctcgcagatgaaccgatcgccagtcttgatcctcaaaccacaaaacgggtgatggatgacttgcggcgaattaaccaagaaatgggcattactgtcgtggctaatctacatagcgttgaggttgctcaagcttatgctactcgcattatcggtattcgggcgggtcaaaaagtgtttgacggtccggttgccgaagccactgatgaaatcatagctagtatttacagcggtaatgagcaggaggtgtcataatgacagctcctacgttaccgaaacgtcagctgcaatggcgcaagtggctgcttactggcatcatggtacttggtttaatttggtcgattgggatcaccaatgcaaatctcgggttgttttttaagaatttcagtcaattcactgtcatttttaccgaaatggcgcatgttgactggagttacgcttattacacaattgatccgatgattcagacattgaaaatggcaatcattggcaccttgattggctctgccgttgcttttccatatgcccttttagtttcgcgcaacattgtgactaataaaattgtggtaggcatttttcgctttgtgctcaatattgtccgtaccatccccgatctcatgttagcggcactttttgtcgccattgtcggaatcggaccagtggccggtatttttgcgttagcgatctttacttttgggatggttggcaagctgttttatgaagcagttgaaacgattgatcctgggccgcttgaagcacttaaggctgcaggtgcaggccgaattgaaatgattcgttttgcagtgttgccgcagatcgcaaattattttgttagcttcgtcttgtatgctttcgaaattaacgttcgggctagtacggtgctcggctatatgggagctggcgggatcggtatttacttgcaacaggcattatccatgtttcggtatgatcgggtcggtttgattgtgctagttatctttgctgttgtacttgtcattgactacattagcggtaaggctagggaggtgcttctatgaatcgctcagcttcattgccaaaggcccccctgcaacatcgttggcgcaattggttactgacaataatcaccttagcgattatcgtttggtcattcacaggtatgccaagtcttgaaatcaaacccaatgcgtgggtcgttaccaagtcaatcgctgcggggttggcacatcccgattttagctatgtttggacaggtgatggcgaagatctgacttctacgctgctgcaaaccttggggatcgcctttttagggacgttcatttcagctattattagtctgccatttgctttttgggctgcgaacacacaacacaagttttggctgacgactcgttctggcaaatttgtcttgactgccattcgaacttttcctgaaattgtcctggcgttaatgtttatcaaagccgttggtccaggctcttttgctggcgtactagcagttggctttcatagtgttggcatgctcgcaaaacttttttccgaagcgattgaaaacatgaacaatcgtgccggagaagccgtgattgctgctggtggcaatcgattggatgtcactgtgatcgccagtttgccacaattgataccagagtttgtttctaatacactctaccgttttgagttggccattcgttcagcatcgattcttggtatggtgggtgctggcggtgtcggaacacctttgattttcgctattcaaacccgttcttggtctagagtgggcatcattctgtatggcattatcattttagtaaccctcaccgactggctttctggttttctgcggaaacggttagtataaagttcgttgaaatcctaacatgtcggatcatttgcagatgaaggtccgctcttcttcgaccaaaagtgagaggttattttagttcagtggcagtcgttcaacaatcaaattgatttgatggaaaaggatttttaaggccgaggttcgcttaattctgtttttgatttcagagacaatgaaaaggtacatcaaggccattttcatgcataaccacagattgatgctggaaaaatgccagaagcactcagcattgaaaaatgtcccgttaaaaaaataattgtgattgctttatgatgccatagtcccatcaaaaaagactccctgagatatttcatctcaaggagtcttttttatccagcaagtcccgggctgcaactgatcagtcgctaccactgactaatgttgtcttcatatccaccttctcggtcacaacaccttcttgataaaaggtattcgcgatttgattttcttcatcgacaatgctgctatctgctttaacgagcgccatggcataagttcggcgttcaaccattttttgaatcacagcgtctgatagtttcaaagtcttactgagcatggcaatgagttgtgtgtggtgattattggcccacgtcatatcatcgttgatataggttgtcagcaatttgctcagcgcggtgtgagttttggcataattttgggttgagatcaggaagtcacgattctttgccaatccggtgccgtttgtcagcaacttggccccttgattgacttgtgctgttgccgtatacggatcccaagtgacccaagcatccacactgccttttgcaaaagcgaccgatgctgaactttgatccatattcactaatttaacatcattggtggacaaacctgccttttttaaggcctgaataatcaagtattgggcggcagtgcctttttgataggcgatcgtcttgcctttcaattgcttgagattggtgatctggctgttcttaccaacaagaataccgctgccatattccttggtggcaccagcagcaatcagcgcaatatccgtgccagcagcttttgctgtcactggcggcgtatcgccaacgcgagcgtagtcgatcgccccacttttcaaagcagtcatgagcgcagcaccatcagaaaactccttgaagacgacttgatagccttttgctttcatttttttgattaactcaccgtgctggcgagcaatgtcgacaggatcggccttttggtagccgatcgtgactgtttccagatcactggccgccgtcgtggtctgcgtatagccatagacggcaacactaagccacatgattaagccgatcaccaagaaccaaaggtgttttttatgcttcataggcttgtccgccttgcatcagctgtttgcgcagtttcggtcggagtactttcccagttgcattgaccggaaaggctttgacaaaaacgacatcggttggacattcatacgctgccaaatgctggcgagcgtaatcgatcaaggcggctttggctttcattgggtcgccggtcacgttttggcgaatgacaaccgccgtgactgcttcgccataaagtgcatccggcaaaccaatcaccgctacttgagcaacccagtctaactcattaaggatattttcgacttttgccggggcaaccttttcaccaccgcgattgatcatttccttacgacggcctttgacaaacagatagccatcttcgtctaaatagccaagatcaccagtgaggaaccaatcgtctttgaaagattcaggatgcggttcgagataatcgtgaatgacgtgatcgccgcgaagagcaatttcaccttcaacatacggttgctggctcaaagaaccgtccgccagcatcagtcgcagttctgtacccaccggcttgccagcagacccaattttcggtgcattaattggatttaaggtactctgactcgccgtctcagtcatgccataaccttcgagaatctgcgtatgaaaatacgtctgaaaggctatcaacttatcttctggcaatgcaaacgaggaactgcggacgaatcgcaaatgaatgtcagggtgataagctttcaaggcgttttcgttcatgagcaaaatcgaaatgattgtcggcacaactgaaacccacgtgacatggttgtctgcgatgagcggccagaatttgctagcggagaacttcggtgcgatgacaagtttgccacctgaaagtcgggtagccaaaaccgaaatcacctgcgcattgatgtgaaacatcggcatcacgaccatggcgatatcatcagctgataaggcatgacttttggcatcgtgttgggccgcattcaacaacatgcgatgggttaagcccacgcgtttcggcttgccagttgtgcccgaagtgttgaggatcaaagccagatcctcttcttttggccgtttctgcggcgcgtttatgcgatacgcaagctgactggcatcagttaaaatcgctagcgctgcgatagtatgcagacgaagccgactgcacggcatcaatggttctgccaacttttcgccaacatcaggcaaggttataactgcctgatagtgatacaatgaccattccgtcttcagttctggcaacggggtcgcggcagcaatcggatggacaaccgcaccaatctcccaaagcgcctgatttaacgccagatggacgggagcgtttggcaaagcgacaagaatctgatcccctgcaccgattttcagtttattcaactggtcacgcaaggctgcgacgtcctcttcaagatcgcgcccggtataccaagtatcggcagcgactgatttcacaattgggtaatcacgctcatttattagattctgagacaacagatcggtgagtttgctcatgattcaagactcctttcgatgaaactgacaaggactgcggacggccaatcagccacccaaacggcgcgatccggtagcatagccaagcaatggtaaatgaaacagctagaataaagatatagccgattggtagtagtaagatcaacatgccattgctaaaaccaccgagactcaacaagccgcctaacaggctaatagcaatggtttgacaaagataaacgccgaaagaaacttgggcaccatgaccgatcagtcgtgccacccaatgttcgggtcgcttcgtatgccagaccgcgtatcgctggcctaatacgaacacaaaagcgatcatcacgacatcgtagatcaacatataaggttggtgcggcgaaacagcagcgttgtgaccaaagttcagaacttgtttgttaaaaacatagagaccaatggtgccgatactgagactcaaagcaccccagccgattaacacctgatgagcaagaagccactgcttgaccttttcatagtgcatgctgacgagtccaccgctgatgaagaagaactgataggtgaaaacattgaccccataggccttaaaccaccataaccagtcgcttgtgttgacatgtggcaacccatacttaatgccgatgactagcagcatttggacgccgaagctagcgacgactaacctgatatgatgaccagccgtccgtttaaatagccacagcatggctggaaacaatagatacaattgtaaggtgaccaaaacgtagtagaggtaaaattgatcgccatgcagcaaggcactgagatagtctggccagaagttggcgatggtaaagccgccaacaccaagcagtactgaacctgccaacaataaagtgttccacaagacgtaaggtacgccgactgttgtgaagcgttttttgtaaaacagcggccaattacgctgacgctggtaatacaccatcgtcaataccaaaccggtcataaacatgaaacccattcgcgtaaaatgaatcattaaatgtgtggctaagaatccagtactgattaaaccgctggatgtttgatgctgaaatgccgttgtcgtgtgattcaacagcacccctgcaataaaaatcaaacgcataagatcaatttcatatagataaggatgcttaacttttttcggctcgcgccgctcgccgtcattcgcctgcttcatgttgtcaccggctcagacacaatcgcgttcaaaactcgtgccgctgtgttcgcaattttctctggtgattgaccacgagcaccgcttgtttcgtatgccagcttgccatctttgacaaccacaatgcgatcggccatgcgtgcagcttcattaacatcatgtgtgatgagcaaactgcttaaatgctgttttgtgaaaatatcaaggatcagatcctgcatatgttgccgcgtcaaggcatctaatgcaccaagcggttcatcgagcaacagtaactgcggcttagctaacaacgctcgcgccaacgccagccgctgcttttgaccacctgaaagttgtacgggataaccatcgcttttgtcagcaaggccaactgctgttaacagtgacttagcttgttgcacgatagcgggatcgtgtgatcgaaaagaaacgttgtccaaattggttaaccacggcagcaagcgatcattttgaaacatcatccgcatgaccagtccattttgacgttggatgtcaccggcagtcggcggctcgagtcctgcgattaggcgaagaatggtgcttttgccgccgccactcatgccgaccagtgccaagaattcacctgggtacaaattaagatgaatgtcatgcaagacagttttatcgttataggtttttttaatctgacgtaaactaataattggattagtcatgcctcgacacctccttgacgccaactaaggaagactttttctaaacttttcgcaatgaggtcggacaccttgccgagcaatgcgtagatcaaaatacaaagcaggacggtgtccatccgcataaattcttgtgcattcgttgccatgtagcctaagccggaactcgaagaaatggtttctgcgacaatcaatgtggtccacatcacgccgagtgcgtaccgcacacccatcaaaatgttgggtaaagccccaggaaaaataattcgcgtgaacaagtcgcgctttgaaagaccataggcacgccccatttcaagcaattctggattggccgttgttataccttgataagtattgatgtagatcgggaacatgaccccgattgccaccaacgatattttggccgattcgccaatgccgatcagaataatcagcaagggaatcaaggatagatgcggaatgttgcgaagcatttgaatcggactatctaataaggctcggattggtctgaccaaaccgttcatcaggccaagtacaaatccgatactgccaccgatcgcaaacccagctgttgcacgatacaggctaatcgcaatattttttggcaattcgccactttgccacaaggtgatgccatcttgaatcaccgttaagggtgccggaagtaaggaactcgtgagccagttaaaactgaccgcggcttgccatccagccagtaatcccaacggcacgatccaaggcagtaccttgaaccaattgatatgtcttttggtccgcggctttggccgttgcgtgagtgtcgtgacttcttgcatcagggccatctcctttaagttgatggtgttcatactaacgagagcaacttaaagctgacttaactccatttgaagagtttatgacctaatcaacataaaaaaatgccctttcagcacgaatcatcagctgaaaggaccggaggtttgtctaaagtggttcttgaccaaaaggaattcataatcaataacatggcgagcacatttgagttttaaatcatttagcttaattctgtcacttcaaaatttaaaaaagggcatcaggtgttggatgtcgcaaatgattttcgcctcattttacgtgcctgtactttgatatttcaccagaaaaagccgccatagttgataaacgagagtgaagaaagcaaccgagatgccaacaaccagaatagcaaaataccagcggccgtcgtcaatgaccgttgattgcggaatagcggccacccaacctaatggcaaaaaccaagtgaggatcatttttaacggtgtattgtaaatggagagcggatattttgaaaattcaaaaaagtcataaactgtctccgataaatccgctaacccttgtgacaacaacgacaccatcccgcctagtaaggttaaggataagaagattaaagaggtggcacagcacatcagcaggaccagcaagaaaataagtaaaggcatgtgcgagctgaatgcaatcgtggtcaaaatcagtacggatatcgccaagtcaccccaagcatcttcatcaaaactttcattcaacaactgaaaaagcggattgacaggtttaaccaacaagccgtcaaactttccttttcgcacataatccgcaatattcagcgtattaatgaaaaaacagcgaaaaatcgcaaatgaggtgctggcaatggcatacgtcgtcaacagttccgtaaacgtatagccctgaatcgtcgggactaacaaatataaaaagcgaagtgccgcaacattgatcaaattttgaatcatcatgccaacaattgaaaaataaaaatcaaaatcgtaaatggccaatgatttgaaattaattttgaaataggttaacagtaagcgcgcatatctcgtcatcagctaacctccctgaaccacaacacgttggatcgctattttcagctgcaagtgatagacaccaaataacgtggcaatatagaggctctgcatgaacaatgtcggccaaaagtcggcagcctgctgctgtgataacaacttaccaatctcaccgaacgcgtattgaaatggcaaaaactgtgcgattgttttcaccgctgctgggtaaaaattcactggaaaaacatttcccgacacggccagcaaaatagcagctttaaacgtattgataccccaaatgctataggtgtagaaagaaaataaccctatgatcgcctcgagttcaaaatacaggacatatccaagcatgaccgccatcaccaacaacggtaacgtctgccacgcaagcgctgactgcctcaccgcgaccaataggatgacatcagggataccgataaaaatcaacttgccaaatgaataaccaacactttcccaaaaataatgggtcagtaacggcactggccgcaataacaggcgggcgatattacctgtacggatatcgtcgtggatagcaaagctagttttcggaaagacagccgtcaatagttgcatgaaaatcaaataagtgatcgtttcggcaaaaacggcacttggtcgatgccataaaacactttgccacagaaaaaacatcacggcaatcgaaattaaattgccaaataagtagaagccaaacgcatagcgattggcgacactccttttcaaaccaattcgaatcatcatcagtcttaacgtcattggccgccacctgttgtcagtcctgatgaaatgacatattctaagcgtttattcgcaatcgtcacagaagccagctcggttgtcgcgatgagtcgcctcataagatcttgaacctctttagaagacaggccagccacgctaaaattgccattgggtagtgtctgcaccccaacgtcagcaagagccgctggcagattagcagaatcaacgagtgaaaattcaatctgtgatggcgtcgcgatttttgccaaagcttgtgcggaaatgtctgtcaacagttttccatgatcaagaattaaaatgcgtgagcaaattttttcaacatcctcaagatcgtgcgaggtgtacaacaaggtcttgccttcgacttgttgtaggaacttaacgattttattcttagtgaccacatcaaggccaatagttggttcatccaaaatgatcagctccggatcatgaagcagcgatgccatcacctccgctttcatccgctgacctaagcttaacgttctaaccggttgctgcaaaaagtcttttgcatccagtaatgacgttaaatgctcaacccgcgccaaaaaatctttttttgaaatgcgataaatctctttgtttaataaaaacgtatcataaactgggagatcccacctaagctgactgcgctgcccgaacacgatgccaatgcgttgcgcatttcgctgccgatattttgtcggatctcccgaaaatgcagcaagtgtcccatcatctgcccgcaaaatccccaacatcatcttgatgagtgttgactttcccgaaccatttaagccgacaatgccaactttttcacctgcctcaatggcaaagctaatatcatcaactgccgtaaaaagtgtacgtttctttttaacaacgccaatttttgctactttgacgtattgtttagtaacatggtctacctcgataagcgccatgaagctccttctttcgttcaaatccatgtgaccccgatgttagtgtcaataaagacatttgtccgtttttgctcagcttcatcgtgcttcctccttaggctttaaaagaataactcctgacatgtgtactttagtagattaccggacgttgtttgcgccgtcaaacaaaatcactcgatagaaagtgaatattatcggcttattatgcctacaatatttcttggtataaattaattgcattattaatatcaaagctcttctattttataactctcgctttaattttttgatgataaatgctatttggtttaaatgttatttccaaattttcgagtaaaaaaactaactactggaaaagcgttcgcaagccatgctatacttgaagcagaaaaaaccgccgcgtaccagcgcggcggtcgggcagaaatgccctcacagaaccatctaatgaacgatggctgttggaacaggcaactaaaagccgcgagatccgctcaaaggaaacgcggcttttagtttgcctatttttctcggagttgtccgagcgccttgcggaattcgtccactgctagtagtagtttggtactggccctgatcaaccttgttagggcgaccaccagtatcatgcacgaaaccacgcaggccgtgatcgtcgttaatgcagcgaccacagacaagtgaatgtacctttctcatcaatgtgtggctgataggtctccccatacgcaccaccacctctctgatctggtaccaccgttcattatccttttctgtgttgcgttcagtatatcagacaaaaaaataccatgatggaagttttttgaatatgacttattcaacagataatagactccatacgaggttagcgaccggcttggtgcagattagcctaaaataagtaattttctaactaaaaattttaatatccgattctttataaacgataaattaagaaaggtccttcccgtcaatggaaaatgaactcaagaagctgctttcgatgcccgatcctttgcaattcaaccagcatcagtgcgaatggctgctagatcatatcggcgatcccaatgccgagattcgggataatcttgtttattccctattagcacgcggttttttaactgaaggtttcacaactgctcaacgaaaagcaattgccacccgcaccacgcaacaagcacaactttttactggtctcaacaattcagacaatgacaaggtcttcaccagaaccttcaccgccttattaggggcgattttattagaaaccgatagcagcaaaccatttctaactgacaaacaaatccaaacttggatagattgggctctcaagtatctgcaagtcgaaaccgattggcgcggttatgttccggtaaaaggctgggcgcatggcattgcccatggcagtgatttgcttgcagcggcagccgctcatcctaagataaccacagcgcagcttcagcaggcgttggatgtcgtcgctaatgtcttagctcaacaaaaaaagcccttcctagacgatgaggaagagcggttagccatggtcgttttacgtgttagtcaaaattcaaaccatgcaactgacagcatcagccgtttttttaacgaaaccgacattattcgctggactgattatacagagcatccgcataaaaacgaagcttattatcgcgtctcgtcgtggaagcgcctgatgatgacgttgtattttatggcaccgtctatgcagccaacactgttgccgctggtgacaaagtattttcagaagatgggttatctcgattaggttatgggtttgtcccgtccgcgccggaacttgcctgcccgtctataccagtattacccgtcgcactagatgattgattgccatcgtcagctccggttgacgccccttgatctgtcgctccagtgccagcaccactattgtcggcattcggcgtagttgttgttcctgcgccgctattgtctgtcactgaccccgagctaccgctgccagtattcggcgcataccaactattccaagggttgttatacccatatccgccagtgcttgtacctgtgtctgtctgcccgttaccaacgttacctgactggccggtttcagcagattgcccactagctgattggtcagtctgatcctgttggccttgcacctcagaagctgtattgctactctcagctggttgactagcctgaccttcatcctgcgccatctgccgtaagcgttcagcatagcgttcactcagatgctgaatctcagtacttaaagtcttaaaattcttatcattgtagacaatatctctctgtgtattaagcacatcggtcaaagcatttaacccagcgagcttcgcctgaaggtctttcttcttgatgtctttcaattggtcatcagtcagcttatttttcttcaggctcttttgattcttgtcagtaaaataggccttttccttgttgatgagttccttataaagcgctatgaccggctgttttctatctgcacgcagcgaatacgcctcactacgcgtctcaagattcgccagtgcctgcaatcgtttggcatcatccttcagcgccacattctttttatgttgtgctcttatagcggttaatgtttgatcaaccttagcattgcgcgcttgaatcgcttgttcagcttgcgttttgttatgccttgcaactccaaaaatgagtgccgcaatcacgacgaccacggccaaactaattaagaccagttttctcctcttcatcactcaatcaaaatatgtagatcacacacggcgatctatctatttttcctccaaatttttatagtttaacgattccccaaatacggtggcgcaaaaaggctacagcactatgcaccattctcctattaattctaccatgtgaagttttaaaatgttataggcgtccataaatcttgctttcagaaatcagcatgcttcagtgcttgccatagttgctgccctcgtgatacatttttgatgagtactagcatgagctttttcatttaacaaacagcacagtcattcttccttccacaaatggaacctcaaaatcgcacaactatttaaacaaataaatccgacaatccgaatgtgaggatactgatgaaagcgacttataaagatcaatccgccgaagtttgggaaattagtaaaaacaacgaattccctgactgggtcaaagaagcttttgaaaagaactaccttgtttggttggatgaccgacttcgtattttaatggccggtttgttcccgccaatgatcgaaagcttacagcatgagaaagccagtgtttttcgcgttcaaggcgttcagtttggggtcgtgaccattggctatctaggtgactatttggacgtcacaaatcaccgcgtcgtctctaagcagcagtttgctaggcagtatcgaattgaaaaaacaggtaactaattttaatcccacattaaataaaaacgcatgtgaacagactagttcagactagatgatcacatgcgttttttaatttcaaaatcagctgactattttcagcgcaacaaaaaacaccttcccgaaaaccaggaaagtgttgaaacgccaaatgttgatcgaatgattaacgcttggagaattgtgaagctttacgagccttcttcagaccgtacttcttccgttccttcatacgagggtcacgggtaagcatgccggccttcttcaatgggccgcggaagtctggatcgacggtcaacagggcacgggcaatgccgtgacgagtggcgccggcctgaccagaaaaaccgccgccattgacgttaacgagcacgtcatagctgccagttgtttcggtgataccgaacggctgggataaatcagtgatcaggttttcatatggaaggtagtcgcgaacgtctttaccgttcatcgtgatcttgccggtgccgggaaccaaacggacccgcgcaacggagttcttgcgacgacctgtacctgcgtattgtacttgtgccacagtaattgcctccttagattaagtttgaaatgtcgagtacttctggcttctgtgccaaatgcgggtgttcctccccagcatagacatgaagcttcaagaattgctgatggccaagtgtattcttggtcgggagcatcttcttaacagagtattcaacgagacgagctgggttatcccgcaagagatccccagcgatttcatgtttcaaaccacctggatgctggctgtggtgatagtaaatcttgtctgaggcttttttgccagtcaacttcagtttggaagcattgataatgatgacattgtcaccagtatcaacgtttggggtgaattgcggcttattcttgccacgcaagatcgaagcaacgacagatgagagacggcccagcggaatatccgttgcgtcgaccacataccacttacgttcgatttcacctggcttagccaaaaatgttgtacgcacgatttgtttcctccataattctgtgcttgtttgaacacgttaagtttccggggcttatcgtggggcaaacaataccagctactagaataccaacgattggcgtctaagtcaatgtaaaaatcgaaaaacgatcgccgcgaaattgtcgactgctcagcaaaccagtagtgccgaaccgccttatctggaacagctttctcatgctatgtttttgaaagaacgcaccatcatccagcacacttatcagtcttgctggatagttcctttctgctggacccctgtacaaaacatttgcaacgcgcgatcaagcgataattggcgtttgaatgttatccggttgctagtcggacgctcatttggttgaagataaactgataggactgtcaaaaaatacaacgtcacttcccgaatttggtaatccggcgcgagtcgttgtttaaaaacggtaaagaaactgtctaagggattcaacaggcctttttgccacgcttgaaacactttgaatcgcgctgcttcatttaagttgccaatatcatggagcaccaactgcaagttcatatcattgtcgtcggttaacaaatggcccagccgattgacgttggcgacaaaatgttgactatctgtttgttcatgcacgatttttgcggccattgcttcacttacatgcatgacaacagcaaggtacaaggcctctttagtcttgaaatagtggtaaagcaacggctgctggacatcagcggcatcggcaatcatccgcgttgtgaccgcagcataaccgtgcgtcatgaataaagtttgtgctgtcgtcaaaatgcgttgcatggttgcttttttctgctgttcacgttgattcatttttttaagctcttttcgtttatcatttgataaatgagtgatattataattgtgcaaaatcaaatgtagaggtgatcaagatgtttcttgcctataaagagattacgcacaacaaggcccgttaccttttagtggtggtgacttttgtgctaatttcctacctagttttctttctgactggcctggcaaccggtttagcgcggaacaaccgaaccgcgattgatgccttaccaggtaactatgtgctcatgtcaaaatacgcaaataaaaatctgttaagctcgactgtcactaagcaacaagtcgaccaagcagacactcatcaggcagcgctgcttggtcaagtgtccgttgtcgccgaaaacaccaagacgaatcaaaaggtgaacagtaatatttttggtgtcaatcttagtggcaagctgaggccacctgtcaccagcggtcgaatgcccgagaacagcaatgaggtactggctgacgacagtgttcttcattacggcctccatcaaggtgaccatatcacgctcaatggcagcgatcaaaagtatcacattgtcgggctcacccatgatcgccttttttacactgtacctgtattctacacaactttaacgacttttcggcaattaaaatacggccaaagtcgtgtccagaacgtttcggttttgattagcccgcacgccttcaaaaaggtgcccgccaaaatggagcaagtcacccgagcgacattgattaacaacatccccggttataccgccgaaacttcgacatttgctttgatgattggtgccatgattggcattatgttgctcattatcgggattttcatgtacatcttgacgatccaaaaaatctcgatgtatggcgtcatgcgggcgcaaggtatccgaacgcgtgccatcatcgccgcattattctggcaaatcctaatgctcgctgtggtaggcgttgcggtgggggcaggcctgttgatgctgactgagctgatacttcccaaaacaatgccattttatgccaatagtatcctctttttcagcattgcgacggcgttaatcgtcatgtcgcttattggtggactattttcacttcgacgcattttacgaattgatccattagcagcgattggaggcgaatgagatggcaattcttattcagttgaaacaagttagtaaaatttacggtactggccataccgcggtcacagctctgtacccgaccgatttcactttaaaggccggtgaatttgcggccatcattggcccttcaggttcaggcaaaacaactttgctgacgattatcggcaacctgcaacgcccaagcaacggtcagattatcgtcaatcatcaagacaccacccatttgaatgaaggccaacgaaccgatttacgcttcaatacgtttggttttattttacaagctagcaatttgattccatttttaaccgtgaaagatcagctcgctttagttgatcggttcaatcatcatcacaaacatgaaactaccatgtcagcactttttgacatgcttggcattagcaacttggttactagttaccctgcagctttatctggcggcgaacggcaacgcgttgccatcgcgcgagcattgtacaacgatccgtcgatcatcctcgccgacgagccgactgccagtctcgacactaagcgcgctttgcaggtcgttgatttgttagcagatatcgcacaccattctcaacgcggcgtcatgatgattacccatgatacacgcttacttgatgctgtcgacaccgtttatgaaatgcgcgacggccatttaaagacgttaactgacgaagggatgcggaaaataaaggcaagtgccatctaaaaggtgatgtcgtaaacgcgctgactgttaccagctatcggctagcaacgaagaaacactcctaaaaattagcactcaattaaaaacagtgctaaaaatttgcaccatctcctagtaaaaggattataatgaacttgtatcaaaaatgagtataaatcatggaggtaatcattatggcatcagtagatcctgaaaagacattgtttctcgatgaaccaatgaacaaggtatttgactggagcgacagcgaagcacctgtacgtgatgcgctgtgggattattacatggaaaagaacagccgcgacaccattaagactgaagaagaaatgaagccagtcttagatatgtccgacgacgaagtcaaagctttggccgaaaaggtcctcaagaagtaaccatcgtcaaacaactgaatatcatgaaccgcggatcgcactatcgggtcgcggttcttttttttgcaaattttaggaagtccctcacgccaaataattaatttcttttgcgcttgaccctgaccttatgtcacggtttattgttatagttgattaagggagcgcgcgaaccaactcggtttgaaaccagcgtataagcgacttcaaggacatcggccgggtcttggccattgtccttggaagtgtctggttaagcgcgcttaggaggcaagtgatgacctattctacaaagcaattagccgatttggctggtgtgacaccacgaacattgcgctactatgacaagattggcttgctgaaagcgcaacgcgatcctgataatcagtatcgcgtttatacccagactgaggttgatcgtctgcaaaccatccgcttcttacaattatttgagatgccacttgcccaagtgaaggtgctgctagacggttctgctgaaaacttaaccgccgctctcaagcaacaacgcaaacgcatcactgcgaaacgcgatcaactaagcttactgctcactacccttgatcaaactttagaaaaaggagtcgatacaatgactgatgacgaaaaatttgccgcttttaaagatcaatccatcaaagcaaacgaacaacaatatggtgaagaaatccggcaacaatatgggaatgatattgtcgaagccagcaacaaaaagttccgcgatatgtcacaggcgcaggtcgcgcaactaactgccctacagcaggaaattttagatgccttaaagccgttagttggcaccaccgatttcaacaccccggaggcaaaacgcgtcttcaaattgcacaagcaatttctacaaatgacctggccttctgaacaatattcacaaaaagctcatcgcggtttagctgcgatgtatgtttccgatccacgttttagcaagtattacgaagacggcaccggcaaagccggagcggctgaaacgttaaatgcgattgtgcggcactatacgcggtaatcacaatgatgttctgccttacctgattgattcgtcaaaaagcaccaaagcgtttgtgttacatgctttgatgcttttttctttggcttagatttaggatgattcttttttacgtacgatataaatattccatacgactaatatcacaatggtcatgaccaccgccactgcgaagataacacgtcccatttttgtgtagacgacaacccctgcatacgccaatcgctgaagtatcacgccaattcccataaccaccgttaccaaagcgattaagcgaaactctgacggcattttaacccaaaaatacaatgcaccaagaattgtgataagaacaattagccccacatcccatggatataaaattttgataccaaattgacttggtatttcctctagccaaatccaagcagcggccccacctgcaaacaccaacgccattaaaataccagccgagaatcgcttccaagatcgatgagttgtcgacacggtgtagaaattgactacccacaaaattagtgctaaacagattccctcaataaaggcaactcccaaatacttccaggggttcagaatcatggcttgatcatcgcgcccattaccgccactcaagaagagatatagccaagaaatgccgacaacaatcccgattagttcaaagcgctcccgcaaactaatcttcggcatttgcgtgagcatctcatcggccattttcttgggctttttcccaaaaaaacttgacgctgagatgccatcttttgaagcatccaccagatcctgtgccattgtataaagtgatttttgaattgccagctcatcgcgtgaaaaggcctttttagtgactaaatataattgtaaatcttcaaagtattgttgatcattttttgacaaggactgtattaattgatttgtttgatcacgataccactgcgaactgtgttcactcatcagcgtcatcccctttatgtaaaactgtagccacctgcacaaccaactgctgccattgtcgctcaaaggcagcaaggcttgttctaccttgctcagtgacatgatagtattttcggtctgggccctcaggcgaaggacgcatgcgactggctagatcaccatttttttcaagctttgctagcaaaggatagattgtaccacccataaccgaattgaatccagcttgctgtaacgcttgaatcaactcgtagccatatatctctcctttagccacaatggcaagaacacatccttcgaggacacctttcaataactggctttgcttcaatttgcacctcgcataactaggttgttttactaactagatagtagcatgtgtttactatgttgtaaagctatctagctaaaacaaaaaaagccaacgccacagcgtcagcctctaataataaacttccttcaagtacagccctgatgctggtgcggtgccgcgtgcttgttgacgatctttgactgcaaacaaacgctgaaagtcgtgaacatcacgccgcccattaccaatttcaagcgctgtcgcaacgagaatccgaaccatgttgtaaagaaagccattgccgtagaattcaaaaataatttcgtttgtcactggatcttctcgaacagttgcctcataaatcgtccgaactttatcgacaatcacgccgccactggccgcaaagcttgtaaagtcgtgtgtgccgactaggtccttcaatgccacttcaattcgttgcacatcaagtttgtaaggataatgaccagtatataggcggttaaacggatttgtatagtaaccacgagccactcggtacaaataccgtttgcctttagcggaatagcgggcatgaaaatcggcatcaacgatttcagctttaagaatttcgatgtctaatggcatcaacgaattcatcgctttcagcatcgactcagccggaatatttcccgggtaatcaaaactgatcacctgacctaaagcgtgaacaccagaatcagttcggcctgaaccatcgacatgcactggctgccccttcgtcattttggttaaagctttttgcagcacaccttggactgtgcgctgttttggttgaacctgatagccagcaaagttggtgccatcataggccagtgttaccttgtaatgcgtcatgatgtcccttctattaagcacgcaacaacagcaacagaccggttaaaacaagcatcccgcctgctgcaacccagtcgcgccgatgatagcttaggatacggtacttcgttcggtcatcgccgccttggtagccacgcgcttccatagcagtagccaattcatcggcagtcgtaaagcttgagacaaatagtggaattagcaacggtacaacagccttcatttgctggaaaatgttaccttcaccgaaatcaacaccacgggcacgctgcgcattcatgattttggtcgtttgatccatcagcgtgggtacgaaacgcaaggcaatctgcaaaaccaaagccagctcggttactggtacgcgaatgacccgcagtggcttcaacaggctttccaccgcatcagctagcgacagcggctgggtactcaaggtgagcaaagtggacatgaaaatgatcaacacaaaccggacaaagataaaggctccgtttatcagaccaaattcagtaatccataaccagccccaatgccagtaaactgtaccaccacgaacgaatagcacctgcagcacaaccgtaaacaaaatcagccaaatcagtgggcgaacccccttaaggaagaagccgattttgatacccgataaccaaatcatgaacagtgtcgctacaaacatcattaggtatgtctgccaattattggctaaaaagacaattccaatatagtagaagctggcgataagtttggttcgcggatctaatcgatgaacccacgagtcgccgggaatatagcggcctagcagtaatttatccacgctggccacctccaatttgcggcaccaattgatctgccaactcgctttcagttagcggttgtggatcaaagtggaaccccttagctgctaattgttgcgccagttgcgccgtctttggcagccctagctgattagcttttaaccaagctgggtcagcaaaaatctctcgcggtgttccagttttgattaacttgccttctgccatgacccaaactgtatccgcatagtctgccacatcatccatttgatgtgtcaccaacacgatcgtttgtccttgctcgcggtgcaactgttcaaacatttgcatcatctcatggcgtcctgaagggtccaggcccgccgttggctcatccagtactaatacctccggctgcatcgctaacacgcctgcaatcgcaacacgacgcatctgaccaccagatagatcaaacggcgacttttccaacacatcatgcggtaagccaaccattttgaccattttatcggccaaagctaaggcatctttttcgctaaccccaaaattttgggggccaaaagcgatatccttagcgactgtttgttcaaacaactgattttccgcaaattggaaaaccatcccgactttttgccgtagcggcttgaggttcttattgttagtttcattggtaatgactttgtcgccaatcgtcaccgtgccggaagttggtttcaacaacgcgttcagatgttgcagaatggttgatttgccagaaccggtgtgaccgataattgctgtatagctgccgtctcgaataaccccgctcacatctttaatgccatcaccagcgaaaggcgtacctgcctgataggtaaagctcacatggtcgaatgtaatgtccacaggtagtctaccaacctttcattgtccatatagtctttcggcatcgcaatgccgcgctgggccaaagcatctttcagcttctccgagtatgggacatccaatcccagtcgtaataattccatcccatgcgaaaagatctcgcttggggtaccaatctcattaattttgccatcattcaagagaataatccggtgcgcttcggccgcttcgtcaatatcatgtgtaattgaaagaaccgtcaacccaagttcgtctttcaattcccgaataacacccaacacttcttgccgaccagctgggtccagcattgatgtggattcatctaaaataataatttccggtcgctgagccacgatgccagcgatggcaacccgctgtttttgaccgccagacaaccgtgccggttcccgatcggcaaaagccgtcatgccaacacgatccaaggcctcgtcaactcgcttaatcatttccggtcgcgggacgccacgattctctaagccaaaagcgacatcatctgcgactgtcgcaccgacaaactgattatcaggattctgaaaaacaatgccgactttggcgcgaatatcccaaacggtttcttcactcaacgtcatgcctgctacctgcacagtaccggattcgggtgccagcaaaccatttagatttttggcaagggtactcttcccactgccgttgtgcccgatgatcgccagccactcacccttggccacatcaaatgaaacatccgtcagcgcttgctgtttggcttcaggataagtgtaattcaaatgttgaacacgaatgacgttgcccacgatgccccttcttcctacgctttgtataccggataatgataccatattttacttagccgatgggagttaggctccccttgtcttgcagtttccaagccatgacgacatgggtgaaaatcatgcatccatgaaaaacaggtttgctagaaattatttttaacgatatcgggattagtactaaggaatgcaaaaaccgcactaaatatcaaactgccaaccaacaacatccaagcctgtactcgcattggagtcgcattcaacatcaccatgccaaattgactgttaccattcacgatcaattgattagtgtgcattgtcatcagcaaaagcacaaggaaaatgactgttaaatagcgagaaccgttcacaaacagtcctgcatatgcggcgccgatcccgactggcataatgacaacaaaactaagcattgccagcagcagaaagccgtcaagtgagtgtggtttcgtcaaccaagacagtggataccattgagcaagaagcaaaatgatgacccagaaagtcgttagtggtataagtgttttgggcaacgcagggggtagtttttgcttgcgatattgtcgtcccgtcagataaccacttaacatcgatatgagccaagcatatgacagccattgcacagtaacgctgtcgttagcaaggtgatccacttccggcatcaataaaccacctgtgctgccatttggtggtgttaacaagaccaataggaaaacccaaacaatggcaatcagtgaccaaatgccgatgacacatattccaatctgccatggtgctctttgtttaagccaattgtgcatgttgttaacctccgttattttgcagtatacaggaaaaaccgccaattttggcggttttctgcgaggtttttcaggttttctgtggttcatgctactgtatgaatgttctatccttgacaataccattgagcttctgcgcgttctataacgcgctcgccagcccagaaacctacgtgtaaggactttggtcgcaatggccaaaacccagccatcacgaccaaagccacttacactccgttttctacccgggctggctcgcgcttccacaaaaaaaatcatttaatgatggagacaaccggttgcccggtgctctcaagctagactaagcaggaactgggcctgccatcatcgtaacgctccatcgatcaaatgatcaaagttggttgaccgcgtgggccatccatttttaactgtgtttagacgagctcaatgataaccattggtgcaccgtcaccgcgacgtggcgcagtcttcaagatgcgggtgtaaccgcccttgcgatctgcgtattttggtgccaagtcactgaacagcttttgcaaagcggacttcacaacaacactgttgtcatcttgttcctcgacactcgcgatttcattgcgaacgtaagctgctgcttggcgacgggcgtgcaaatcgccgcgtttgcccaaagtaatcatcttttcagcagttgaacgaacttctttagcgcgggcttcagtcgtgacgatccgttcattgatcaaaagatcagtggtcaggtcgcgcaacaatgccttacgttgtgagctggtccgccctaatttacggtaactcatggattggcctccttttcgaaattagtcttctttacgcaatcctaagccgagatctgccaacttgtttttaacttcttcaagtgacttacgacctaaattacgtactttcatcatatcggcttctgttttgttggttaactcctgaactgtgttgatcccagcacgcttcaagcagttgtaagaacgaacggacaagtcaagctcttcgatagtcatctcaagcatcttttccttgtgagtctcttctttttcaaccatgatttcagcgttcttggcttcatccgtcaaattgacgaagatgtccaagtgttctgtcaggatcttcgctgctaagctgatggcctctcgtggcgagattgagccattagtccatacatccagcgttaacttgtcgaaatcattccgacggccaacacgggtgctttcaacttgatagttaacccggctgatcggggtgaaaatcgagtcgatcggcaaaacaccgattggcatgtcatcagacttgttttggtcagctgccacatacccgcgaccctttttaacggtcatacgtacatggaagtgcccgccatctgcaacagtacagatatactgttcaggatttaagacctcaacatcaggatcagcgacgatatcagcagcagttaccttagccggaccgttgacatcaatttcgatgttcttgtcttcatcagtgttcattttgagtgccaattttttgatattcaaaatgatctgggtcacatcttccagcacaccgtcaatcgtggagaactcatgtagtaccccgtcgatttggatgctgctgatagctgccccaggcaatgaagaaagaaggatccgccgcaacgagttacctaaagtagtaccgtagccgcgttccaacggttcaaccacaaacttgccatagttggtgctttcgtcaactttggtaatgttcggcttttcgaattcgatcatctagtttgtacccctttcaaaacgagaagtgaagatttgtctgcctgaccgttaaagcggccgaagggtaacaattaaacacgacgacgctttggaggacgagaaccgttatgcggaaccggtgtaacatcacggatcgcagtaacttcaagaccagttgcctgaagtgaacggatcgcagcttcacggccagaacctgggcccttaaccgcaacttcaaccgacttcatgccatgttccattgattcctttgcagcagcttcagcagccatctgcgcagcaaaaggcgtcgacttacgactgcctttaaagccgagtgcaccagcagaggaccaagcgatcgcattgccgcgagggtccgtgatcattactaaggtgttgttgaatgttgagtggatatgagccacgccagattcaacgttcttgcggacacggcgcttccgcgtagtttttctacctgccatcgatcaatgacctcctttaattattttttcttacctgccatgcttgctttcttccctttacgggtgcgagcattgtttttggtgttttgcccacgaactggcaagccacgacgatgacggatgccgcgatatgaaccgatttccatcaatcgcttgatgttcaggtttacttcacgacgaaggtcaccttcaaccttaacggagtctaaggctgcacgaatcttgtcttcttgttctggggtcaggtcatcttgacgaacgttttccggaacaccggcattcttgaggaccttttgagcggttgtcttgccaacaccataaatataggttaaggcaatgacgatttgcttaccacgtggtaagtcgacacctgcgatacgagccatgtacaatgacacctcctattgaattagtttgtattatccctgacgttgcttatgctttgggtttgcagagcagataatcatgacccggcctttacgacggaccactttgcagtgctcgcacatctttttaacagatggacgtactttcatgagaatttagcctccttgagttggcaactacttgaaacggtaagtgattcggcctttggtcagatcatatggggagagctccaccgttaccttatctcctggtaaaatccggatatagtgcatgcgaattttaccggaaacatgggcgaggatctctgcgccgttttcaagtttgactttgaacatcgcgttgggtaaggtatccgtcacggtgccttggatctcaattacatcgtcttttgccacgaagtgtttcctcctaaaaattattggttctattaacgcgcgaaaagggtgaggccgattggcactcaccgcataccgcgatattgtaccataattcttcgactttgaaaacagtcatgaggggcgtgcaatcgtccaagcacttactttgccacagcagccaaaatcgctttgatctcggcaaacaccttatcaatgtcctggtcgccattaaccgtgtgaagcaggctcttcttttcatagaagtccaacagcggtgtgttcatttcgatgtttaccttgagccgatttttaaccgttgccggtttgtcatcttcacgctggaagaattcatgaccgccgcaacgatcacaagtgccggcaacctttggcgggttgtagaatttgtgataagtcgcgccgcatgtcttgcaaataaaacggccagacaaacgatcgactagttttgcaggtgcaacatcgatattgatgacagcatctaacggtttcttcagatcggctgtaatcgtttcgagtgcctctgcttgttggatggtgcgagggaagccatcaagcatataaccagcatcggtatcagattcagcgagtcgttccttgacaatgccattcgtgaccgagtccggtacgagttgccccttatcaatgaaacctttcgcttctttacctaatgcggtaccagcagccatcgcagctcggaacatgtcaccggttgaaatatgtgcaatcggataagtgtcttcgatccgttctgcttgagtacctttccctgcaccgggaagtcccattaaaatgagattcacgttgcatcctcctctaaacgcgctcgccagactagaacctgacgtataaacgctcttaaacacaataaccgaacccggtcatcatactcagattcgcttacacattggactctaatcaagctgactcacgttctgtttaaatgacgtttattttttactgtcgcctttaatcaagtctccgcgaatgaaaccgatatactcgcgtttcatgagtaagccgtctaactgacgaaccaattcaatcgctgtcatgacgacaatcaagagacttgtgccgcccagtccgattgactgtggcaagccccaaatgttggcagctaactgtggcagcaatgcaaccaggccaaggaacaatgccccgacggttgataaccgcatcagtaaacgcgagatataattctcggtttcttttcctggccaaacgcctggaatgtaactgccttgtttggttaagttctcagagaccttttcgggattgacctgaacaaacgcatagaagaacgtgaaaagaatgattagaagcgtgtagatcgcagtcccggcaggtttttgcatattgaagatgttggtcatgacttgataccagccatcaccgctatgattcttttgaaaagccatcagaattgtttgcggagttacgatgaaggaactcgcaaagataactggaataacgccggccacgttgacctttaaaggcaagtagctgttgctgcctgcgctggtgacacgccgggtatattgaatcggaatcttgtaatttgcttgctgtacccatgtgacaaacgtgatcactaggatcacgataatggctaaggctgccatgaaggcaatccctttccagatttcggcaccagagtatacctgaacgttatcgcggtatagctcttgaaggccagaaggcaagcgagcaatgatcccggaaaagatcagcaaggaaaccccattaccaagacctttatcagtgatctgttcacccatccaagtcagcaacatggtgccgccggttaagatgatcccgatcgtgatataggtgctaacagacggatttttgaccaagcccatcgaacttaacgtttgaaagccggccgtaatcccaattgcctgaaagaacccgaagataatggttaagtaacgagtcacctgattcagcttacgccgaccaacttccccttgcttgctccattcaacaaacttcggaacgatatccatctgcagcagctgaaccacaatctgtgccgtaatgtacggtgagacccccatcgagaagatggagtactgggccagtccgccaccactgacagtatccagcagtgagatcaggcctgtcgaaccgattgattgcagcgcctttgcattgaccccgggcactgcgatcagtgtacctaatcgatagaccaataaaaccgctaaagtgaagaggatcttgttacggatgtctttaaccttgagcgcgtttttcagggtcctcagcattagatcacctcaatcgaaccgccagctgcttcaacagcagccttcgctgcagcagaagcctttgctaccttaatggtcagttttttctcaagcttgccgtctgccagcagcttgacgccgttcttttcgttcttaacgataccagcatcgatcaaggctgctggggttacttcggcgccatcgtcgaagcggttaagatcggaaaggttaacaacagcatattctttgcggttaatgttgttgaaaccgcgttttggcatacgccggaacaatggcatctggccaccttcgaagccaagacgcgttttgccgccctgacgtgccaattgaccctttgtccctttaccagctgtcttaccttgaccgctagaagtaccacggcccagacgcttgcgggaatgacgggagccgacactcggctttaattcgtgcaattgcatactcttgggcacctccttgtcgaaataatgttattaatccttgatttcttcaacggaaaccaagtgtgaaatctggaaaatcgcaccacgagtggctgcgttgtcaggcttgatcactgagctatttactcgagctaagcctaattccttcacaattttacgttgcttaggaagacggtgggcagcactacgggtcaaagtaatcttcaattgagccatgtgtttacctcctagtcttctaatgatgacgcagaaacgccacgcaattcagcaacttgttcacgggtacgcagttgtgtcaacccgtccatcgttgcccggatcatgttgatcggggtgttacggccgagtgacttgctggtaatatcagcaatgccggcaagttccatgacggaacggatagcgccaccagcagcaaccccagaaccttcttcagcaggcttcagcaaaacttcgccggcgccaaaatggccgataacttcatgaggaatcgttgtgccgacaatcggtacttcgatcaagctcttcttggccgcgtcaacagctttacggatcgcttcaggaacttcttgggccttaccagttgcaaagccgacgtgaccattcttatcaccgacgatcgcgatcgcagcaaaacgcagacgacgtccacctttaacaactttcgtgacacggttgatggaaacgacttggtcttctaagtccaattggtttggatcgataaatgatgccatgtgttggttatcctccttttttctagaattcgaggccattttcacgtgctgcttcagctaacgcagcaacgcgaccatggtacagataaccaccacggtcaaagaccacaactttatgaccatcagcaacagcacgcttggcgatcaacgcgccaacttgtgcagaagcagcagtcttgttttcaggatctttaatgtccttatcaagagtggaggcacttgctagcgtcacacccgctacgtcatcaattaattgtgcgtagatgtttttattcgaacggaaaatgttcaagcgtgggcgctcgctcgtaccagaaatcttgcctcgtacgcgggcgtgacgccgttgccgagtcttgttcttatctggcttagaaatcacaatgttcacctcttgttaaatttgttgaaggttaagactacttaccagtcttaccttccttacgacggacatgttcgtcaacgtaacgaatccctttacccttataaggttcaggtgcacggacggaacgaacaacggctgcaaactggccaacaacctgtttcgagatcccgctgatgatgatctgagtggtgcttggaacttcaacagtgacacccttaggcgcggtcatttcaactggatgggaatagccaacgttcaaaacaagcttttcgccttgtttttgtgcacgatagccgacaccgaccaacttcatttctttcttgtagccttcggtaaccccgacgaccatgttgttcaagttggcccgcattgttccgtggacagccttgtaggaatcatcaggacgcgtgaagttgatctcgtcgccttcctggtgcatttcgatttccggggcaaaatgacgggtcaattcgcctttcgggcccttaaccgtaatgttgtcgccatcttttgtgatggtgacgccggctgggactttaatgactttataaccaatacgactcacttatcggcacctcctttttgatatattgaattaccaaacgtaggcgagtacttcgccgccgacattcttggcacgagcttccttgtcggtgataacaccttcggaagttgagatgatagcaatccctaagccgtttaagaccttaggaacagcatcacttttaacgtatgagcgcagacccggtttggaaatccgcttcaagccagagataacccgttcattattcttaccatacttcaagaaaatacggataacgccttgcttgtcatcatcaataacttcatagtcacggatgaacccttcacgtttcagaatctcagaaatgtcttttttcatcttagatgcaggtacgaccaaggattcgtgacgcaccatgttggcgttacggatccgggtcaagtaatctgcgattggatcggtcaagaccattgatttaacctcctttgtctagtgattaccagctagctttgcgcatgcctggaatttggccggcatgtgctaactcacgaaggcaaatccggcagagtttgaatttacgataaacggaatgtggacggccacaacgttggcaccgcgtatattcctggactgcaaattttgcaggccgattgttcttagcgatcattgacttcttagccaagtagcggacctcccttatttggcgaatggcatcccgacttgcgtcagcaattcgagagcttcttcatcagtatttgccgttgtaacgatgacaacatccaacccacgaacacgattaaccttatcgtaatcgatttctgggaagatcagttgttctttaacacccaaggtatagttcccgcgaccatcgaaggacttgggggaaataccatggaagtcacgcacacgcggcagggagacattgatcagcttatccaagaaatcatacatgcgttcgccgcgcagggtaacctttgcgccgattggcatgccttcacgcagacggaagccagcgatactcttcttagccttggtgatcagtggatgttgaccagagatcagggtcagttcgtcaactgcttcatccagcaatttggcgttctgagtcgcatcaccaacacccatgttcaaaacgatcttttcgatcttcggtgcctgcatggtgctcttgtagttaaacttgcttaccaatgcaggagcgatttctttgctataacgttcttcaagacgattctccatgaaaaagtttgtcctccttccctattatttatcgattgcggtgccagacttcttagcaatccgcactttgttgccatctttaacttcagaaccgatccgtgtcggcttattggtatctggatcaagaagcatcacattggacacgtgaataggcgcttccttatcgataataccgccttgcggattagcattgttaggcttttggtgcttcttgatcatgttaatgccttcaacgacaactttatcagcgtccttcaagactttagtgatctggccttctttgccggcatctttgccgcgcatgacccgcactttgtcaccagttttgaacttcatgtatcgcacctcctatttggtcagaatgattaaagtacttcgggcgctaaggagacgatcttcatgaaatcgccgtcacgcagttcacgtgccacaggtccaaagatacgagtcccacgagggctcttgtcggcgttaatgataactgctgcgttctcatcgaacttgatgtaagaaccgtcagcgcgacgggcgccagacttggtccgtacaatgacagccttgacaacgtcagccttcttgacaacgccacctggtgttgcttgttttacagttgcgacaacgacatcaccgatgttaccagtcttacggtatgaaccgccaagtactttaatcaccaggatttcgcgcgcgccggaattatccgccactttaaggcgactttcttgttgtatcacggaatggtcctcctttcatccgaaaaattgattagatgataactgccttttcgacaatgttcaataaacggaaacgcttattgcgtgataaaggacgtgtttctgcgatccgcacgatatcgccagttttagcggtattgtcttcatcatgcacgtaatacttcttggagtacttcatacgcttgccgtaaacagggtgcatcttgaccgtgctgacttccacggtgatcgtcttgtccattttatctgagaccacgcggccttgataaaccttacgagaattacgttctgccaaggtaaatgtctcctttccgattatttattgagtgcctgttgccgaaggaccgttttgatccgtgcaatgtttttccgaacctgactcaagcgagcggtgttttccaattggccagtcgcctgttggaagcgcaagttgaacagctcttctttatattgcttctctttgtcgagcatctcagcagtggttaatgcagtaatttctttagccttcatttgattgcccacctacttcctcgcgtgaaacgatcttggtacggatcgggagtttgttggatgccaaacgcaaagcttcctttgcgactgcttcggaaacgccaccgacttcaaacatgatcttttcacgtttaacgacagcaacccatccagttggtgcacctttaccattacccatccggacgccaacacctttactggtgtaggacttatgagggaaaatgcggatccatactttcccaccacgcttcatataacgggtcattgcgacacgagcagcttcgatctgacggttggtgatccagtgggattccaatgcttccaaaccatattcaccgaagtcgacgttacggccgcctttagctgcaccgcgcatcttcccacggaattcgcgacgatgctttacacgcttaggtactaacattgattatttccctcctttcacactattttgctttggcttttcaggtaaaatctcaccacgattgatccaggttttgatcccgatacggccataagttgttgcggcttcttcccatgcgtagtcgatatcggcacgcaaggtatgcaatggtactaagccttcattgtaatgttcgcgacgtgcaatatccgcaccattcaaacgaccggaagcttgggttttgattcccttggcacctgctcgcatggtccgttgcattgcttgacgcattgcacgacggaaagcgatccgttgttcaagctgacgggcgatgttttcgccaacaagcttggcatccagatcaggtttcttaatttccacgatgttgatgtgaacttgacggccagtcagcttgttcagctgcttacgcaagttttcaacttcagaaccgcctttaccgataaccatacccggcttagcagtatgaatggaaatgttgacgcgctttgcggcacgttcgatttcgatacgtgatacggaagcatcttgcagcttcttgttaatgaagtttcggatttcaatgtcttcatgcagaaaggctgcaaagtctttgtctgcataccatttggcatcccagtcacggatgacaccgacacggaaaccggttggattaatcttttgacccacgcgttatccctccttatgcttctttttcggatacaaccacggtaacgtggcttgtccgtttgttgattggtgatgcgctccccttggcacgaggacggaaccgcttgagggtcgggccttcgttgacgtaagccttgcttacataaaggttttgtgcatctaagtcatagttatgttctgcattagcgatggcagacttgagtaccttctcgatgatcggtgaaccggatcgaggggtgaattctaagattgccaatgcttcagcaacatcgcgaccgcgaatcaagtcgattaccaggcgcgctttgcgagcagcaatccgaactgtcttggccgttgccgttgcagacgtaatttgatcagccatgaatgttgtgctcctttctagcgtgctgttgtcttcttgtcgtcggtgttatgaccgcggaaggtacgcgtaggaacgaattcgcccaacttgtgaccaaccatgtcttcactcacgaaaactgggacatgcttacgaccatcatatacggcgatggtgtagccaatgaaacttggaaaaatggtggaacgacgggaccatgtacgaataacggtcttcttgtcgttatctgcctgcgcttcaatcttcttcaggagatgagcgtcggcaaaaggtccttttttaagactgcgacccattttgtgacctcctttaatcgatgtaacacttcaatgtgtttacttcgctctgcggtgacgaacgatgaatttctcagacttagccttgtgatcccgggtcttcttacccaaggtcttcttgccccatggtgacattggagatggatggccgattggtgctttaccttcaccaccaccatgcgggtgatcgttagggttcataactgacccacgaactgtcggacggaagcccaaccagcgcttgcggccagctttaccaatactgatcagctcatgttgctcgttaccaacggcaccaattgtggcacggttttcggccaaaatcagacgaacttcgcctgaagctaacttaacggtaacgtacttatcattatctttacccaacaattgggctgaaacaccagctgaacgtgctaattgcgcgcccttacctggcttcagttcgatgttatggatagttgtcccggctggaatattcttcaattgcaatgagttgccgactttgatatcgacatcttcaccagaataaaccttgtcgccaaccttgagacccttaggtgccaagatgtaagacttaaccccatcttcataatgcagcagtgcaatgtttgcggtccgatttggatcgtattcgattgctttaactgttgcagccatgccatccttattacgtttgaagtcgatcacacggtagaattgcttgtgaccgccgccacgatgacgcacggtgatgtgaccatgggcattacgtcctgcagtatgactttggctgaccagcaaagtcttttcaggctttgtcttggtgatttcagcaaaatcagacccggacatgttgcgccggccgttgcttgttggtttgtacttaataatcgccacgtgttttacctcctataacggatttttgttactttttatcgttatcttcgtcagcgaagatcttgatttctttggaatcggcgctcaaggcaatcaatgccttgcgacgacgacgcgtcatgccttcgtaacggccttgacgcttcttcttaccgcgaacgttcgcgatgttgacgttgacaaccttcacaccgaagatttcttcaacagccttgcgaacttgcggcttggttgcatgcagtgcaacttcgaatgtgtatttacggttatccatttcagccatcgattgctcggtgacgatcggacgtaaaatgatatcgcgtgcttccattatgcaagcacctcctcaatcttttggagcgcagattgggtcaagattaatttcttgtagtcaacaacgtccaaaacgttgataccctctgcaggaacaactttcacgttcggcaggttacgtgcggctttggcagcaacttcgttgccgtcttccaacacaaccagtgccttgtcgctgaccttcaagccatccaagacagttgcaaaagcttttgtcttaggtgcatcgaagttcaaaccgtcaacaacgaccaagtcgctatcgagaaccttctgtgaaagtacggatttgattgccaaacgacgaaccttctttggcagcttgtatgcatagctgcgcggggtcggtccgaagacgatcccaccgccacgccattgcgggctgcggattgaaccttggcgggcacgaccagtacccttttggcgccaaggcttgcgaccgccgccagaaacagcagaacggtttttaacggcgtgagtaccttgacgaagggaagcgcgctgcatcacgactgcgtcaaacacgacgttttcatttggttcgactgcccagatggcatcgttgagttcaactttgccgttttctgagccatcttgcttatataaagtaacgttagccattagttattgtcctcccttcgtattatttagctgctttaacagcagaacggatcgtaacaaaggacttgtttgcccctgggacattacctttgatcaacagaacattgtgctctgtgtcagcggcaacgacttgcaggttttgcatggtgcgggtgtggttacccatccgaccaggtaatttcttgcccttgaagaccttgttaatgatggccccaagtgaacctggacgacgatggtaacgagaaccgtgcgccataggaccgcgggattggccatccttcttaatgttaccttgataaccgtgacccttggaagtaccagtgacgtccacaatgtcgcctgctgcgaattcgtcagccttaacttcactgccgatttcataatcactaagcgctacatcgcggatttcgcgaacgaagcgcttaggggtcgtgtctgcctttttggcgtgaccgacgcttggcttattcgtcaagacttcacgcatatcgccgtagcccagctgtactgcttcgtaaccgtcagattcaacggtcttgacctgcattacaacgtttggagttacgtcgacaacagtaacgggtacgagttcgccgttatcggtgaagacctgcgtcatgccaacttttttgcctaagattcctttacgtgccatgggtacacctcctattttctaagaattataatttaatttcgatatcgacgccgcttggcaagtcgagcttcatcaaagcatcaactgtcttcggtgttgggttaacaatatcgatcagacgtttatgcgtccgcatttcgaattgttcacgtgaatccttgtacttatgcggggaacgtagaaccgtgtaaagtgtacgttccgttggcagagggatcgggcctgaaattgttgcgcctgtgcgctttgcagtttccacgatcttgtctgcggattgatcgagaatccggtgttcataagccttaagccggatccgaatcttttgttttgccattgtgtgacctccttcgtctattatcagttagtagactagctccgtgaaaattaccaacacgctgccgtggcaaagcggccgggcgtgtcgcaacctctcacatccgcgctactctggttcacctttggaaccaagtgcatagttgtcccctttgagaaacagcactcttgatagtatacaaaatctcccccgccattacaaggttttctttcggtttacaaaaaatatgttagaagcaaacttattcctttgaacagctgcttgtgctaaattcaaattaaagccttaacttttgaataaccatagaaagaagggaggcagttgatgaaatttgaccattacaaaaagctcgtcaactcaactttagatattctactcggttttttagccattgtcgtggtaatttttatgctacgctacattctcgatatcggtagtctgatccttcaaccactttcgactgctttgtttggcaaagtcattcaggaagttaccagcttcttcatgctctttgaatttgtgatcatgctggttcgctacattgaggaaggtcatcacattcctatccgctaccttattttaatttcaatgaccgctatcttacgccaactactcgtgctgcatgaccgcgggactgaaaccttgcttttaaccttggccattttggtattagccggtgtactcacggtgttttcgtttgtcagtggcgatttcaaacagtcgcaggatggtaaaaacgttgatattgaccaacacttttaactttgttttttctcgtttcttctatattaatttatacacacaaaaaggaaccgcagcgaaaatcattgcggttccttttttgcgtgcgtcgctgattagccaagcgctgatatattgactgttagctgatcaaagcaccgttttaaatcttgccaaccaagtctgcccctggtgtcagtgtcttagcgcccggttgccagttagctgggcaaacctgatcgccgtgagcagcaacgaattgtgccgcttgcaaagtccgtagaatctcatcggcattacggccaatgccaaagttattgacggcataggcttgaatcacaccatcgggatcaatgataaaagtcccacggaaggcttgaccgctagcttcgtcacgaacatccaacgccgttgccagtttacctgcaggatcggcaagcattgggtattgaatcttcttaatggtgggactcgcctcggcccatgccatatgtacaaactcggtatcctcagaagcagaatagacttcagctccaacagcttggaaccgctcatagtgatcttgcaagtcgccaagttctgtcgggcaaacgaaagaaaaatcggcagggtagaaataaatcactgcccacttgcccttaagatcagtatcactgacttcatggaaatcgccatgttgataggcgttcaacttaaacgccggtaaatgttggccaatatagctcatgatattacctccatttttagaatgattattatttacatattcaccgtaccttttccttatgcaattatcaagcattgccaaaaaaattctgcctttttgtcggcagtcaactttggccacctttacctgtttaatgatgccgatctcctataataaggcatacgagaatatgtgttcacatcacgccgtcatcatgcgcttgccttcccagaaatcgggttggttcgcactcagcaaaaaaccgagtctgcattcattcgcaaacccggctgcacaactgctataaatacttgccagtatcatcttcgttttgataattcttcaaacttttacgcaagacccgaaccacataatcacgaatatgtttgggagccaggacttttacgagatccccttgcccttggagccacatccggacgccaaaaccatcgttaaccggaatcgtaatgtgataaacctttcttgcgtatggattcttaataaacggacgatcacggacatttttccaatcaacaatggcctcgggaaagcgatcaaggacaaactgcggatcataactgtagagaatttccaaattgatcggtttgcctagatacggataccacgtgtgattctgtaagcgtccgccgcggaatcgctcatcatgatcatgggtcggctgctgacgatgataggtaatattgcgcatatagtcgagccgaaatcggacgaatttgccctcgtctggatcatcatccgcctgttcatcgctgccatcaacaataagatagaagaagagatcgccaaaaaacaagccggttggcagtcgccggtcaaagtgccgcatttcgccgtgatacacgtgatcaaagctgatcagttcgtgattaacgatagcttggctcaatcgggccaaccgattagtcaacgatattttggggacaccacgatactcaaaaactggatttttggtaagccgatccaatcctttgtgctcgggtccggctggtaataattgtgccattagttgcttcatttctacggacgacaagccgcggctagccgtcagtatcaaggcaatcgccaacagttgcccgtcgtccagactgcggccagcggcgtgcaggtttggcttgagtcgataatccccagaacttgcagcaataaatggcgccggttcactgaacacatcgtcaaaggcacgtttgatgacgctaatatcacggcgaatcgatgattcatccttattgaattccgtcatgagcgcttgcttattgagttgatcgcctcgcagcaagcgcaataaaatggtcgtaatacgctcctgactcgacacgctgcttcgccccctaacgcttatagaataacatcagtatactataatcttttcccaagcccagcaatcaggttcacgattttcatgcttatttccggattttgacttctggcgcacttttagaaaaaaacgacgatgcctaaaaggcatcgtcgttcatgcagctggtaacaatcaaagactagtctttggtcgcgacgccgccgccatttttcttgatgatttctgcttgaatgctctttggaacagcttcgtagtggtcaaaggtcatggtaaacgtaccacggccttgggtagcactacgcaaggtggttgcataaccgaacatttcggcaagcggcaccatggagttaaccaattgggcattcccgcgggcttccatcccttcaacgcgaccacgacgagccgtgatttgtcccataacatcgccaagatattcttcaggggcaaccacttcaacgtgcatgatcggttcaaggataaccgcgccggcactcttcgaggcattcttcaatgccatagaagcagccactttgaaggcagcttcagaagaatcgacttcatggtaagaaccatcataaagcttagccttaacgtcgattaatggataaccggcgaggacaccattggccatggcttccttcagaccttgctcaacagctgggatgtattcacgaggaacaacaccaccgacaatggcattttcaaattcaaagcctttgccttcttcgtttggactgaattcaatccaaacatcaccatactgacctttaccaccagactgacgaacgaacttaccttgcgcggaagtttctttagtgaaggtttcgcgataagcaacttgtggttcaccaaccttagcagcaaccttgaattcacgcttcagacgatcaaccatgatgtccaaatgtaattcgcccatgccggcgattaatgtttcgccagtttcagggttggtttcagctttgaatgttggatcttcttcagaaagcttttgtaagccgacatccagcttatcttggtcttctttagagtcaggttcgatggaaacttggataaccggatcaggcacatccagagattcaagaatcagcgggtggtcaacatcagtcaaggaatcaccagtagtggtgttcttgagaccgatagcagccgcgatatcaccagagaaaacttcagggatttcttcacggtgattactgtgcatttgcaacagacgaccaacacgttcgcggttatctttagttgcgttcagcacgtaagaaccggcttcaagcgtcccactataaacccggatgtaggttagacggccaacgaacgggtcagtcgcaaccttgaaggccaaggcagcaaacggcttgtcgtcgccagcggtcaattcaactgcatcgccagtgtcaggatcggtcgcatgatatggccgaacatcaagtggtgatggcaagtaatcaatcacagcatccaacaacatctgaacacccttgttcttgaaggcagaaccagccaaaactgggtagaattccaagttgatggttgctttacggatcgcagccttcaattcagcattggaaatctcttcaccttcaaggtacttgtccatgatgccgtcgtcaacgtcagcaacggcttcgatcaagtcgttatgcgctttttgagcagcttccttgtagtcatccggaacatctacagtgtcccacttggtacccaattcatcttcgtcatacaaatcggccttcatttcgatcaggtcaatgaccccttcgaacttatcttcggcaccgatcggcatctgaacggcgtgagcgttagcctgaagccgatcatgcaatgtcgtcatcgaataatcgaagtcggcaccgatcttatccattttgttgacgaaaaccaaccgcggaacgccgtatgtcgttgcttgacgccaaacgttttcggtctgcggctcaacaccggattgggcatccaaaacggtgatcgcaccatccagcacacgcagggaacgttcaacttcaatcgtgaagtccacgtgtcctggggtgtcaatgatattgacccggtgatccttccagaaagccgtagtagcagcactggtgatggtgatcccacgttcctgttcctgtggcatccagtccatctgtgaagctccttcatgagtttcaccgattttatgaattttaccggtataatacaaaatccgttcagtcgtggtcgttttaccggcatcgatgtgagccatgatcccgatattacgggtacggtctaacggaaattcacgtttgttggccatgtggcgtattgctcctctcttgtttcaactggctttatacaaagaatggctactatataccaagccgcggatataatagccaaatcatcttaccaacgataatgtgcaaatgcccggttggcatctgccatcttgtgggtatcttcacgcttcttcactgcggcaccggtgttgttagcggcgtccatgatttctttagccaagcgttcgtccatcgtatgttcaccgcgttgacgggaatactgaacgatccaccgtaggcccaaggtggtccgacgatccggacgaacttcgatcggcacttgatagttagaaccaccgatacggcgagctttaacttccaagaccggcataacgtttttcattgcttcttcaaaaacgtccaatggttcgttcccggtttgtttcttaatcatatcaaatgcatcatataaaatagttgatgccttcccgcgcttaccatcaatcattaagtggttgatcaagcgagttaccagctttgaattgtaaactggatcaggtaaaacatcacgttttgcgacactgcctttacgtggcatgcactttgcctcctcttaaacgcgatcgctgacgcaaaaacctgcacataaggaccttggtcgcaatggtcaaaaaccgaccatcacgcctaagcccacttatgctccggtttctaccgcgccagctcacgctctgtctataccgcacatagcggatctaaaaatttttaatagcgatctttaatgttgatcgtgaattacttcttcttagggcgctttgcaccgtacttggagcgaccctgcatccggccgtcaacaccagccgtatcaagcgcaccacgaacaatgtgataacgaacccctggcaagtccttaacacggccgccacggatcaagacaacactatgttcttgcaagttatggccaatacccggaatgtaagctgtcacttcaattaagttagacagacgaacacgggcatatttccgcaatgcggagtttggcttcttcggtgtcatggtaccgacacgagttgccaccccacgtttttgcggtgctgggttattggtaaggctcttcttcttgctgttgtaaccgaagttcaacgcaggagagtctgacttggttgaaattgatttacgaccttggcgaactaattgattaatagtaggcattaagcttctccttccttaatttacatcattttataagtccacacatccaggcggttcattttttctgataaaaaaatggccaaccgaacggcaacggctcttaacccagtcagcacgtccgggcaacccgaataaactggaaaaaagcacctttgatagtgtactatcctttgcggctgagtgtcaagagaaaaagaaagagcggggtgactcgcgcgacaaactcaaagatttgtattagttctatttgagtcgcgtgttctcgattgtccgagttggctacgcggcgaggagggctggcgaccgcgaagctagagctgtgggcacagctttgaactcgcgcaaagcccgcacgatttcaaagtctggccttgttctaaaacgggaaaaccacccgtttaagaacaatatcacggctgagccccctcgccgctttgccagctctcatggctctattcttgaattcataccttttaagatcagcatcccccgactttagttccaatcaaagaagtggtgagccgttctcaaatagcagattcaccggttgtaactaagttgttactttttcaataaacacagtttatcaaccgctttaatcggccccgaacggccatacccctaaccataacaaaatagctccgcaaagcaagtctccggctagaagactcacctcgcggaactactgtaacgtgatgccgttcagtctcgaacagctcgtgtcaattgattatgatcgcttgcgccgccgcaggatcacggtgctgccggcgatgacgagaatcacgatgcctaaaaggacaagggtaatcgcatctcgatcaccaaagctgccgaagagtaagcggcgtgacggttggtcatggcgcacatcgttaccattattcccaccttctgtacttggcagaacatggcgctggtcggcgattgtcatgcggattgtatcaccgctcttaatatcaactgcgaccggctttgcgtagtccggattaatcgtgtacccagccggcgctttgacctcggtcagccagtaacgacccagtttcaggttatcaaaggtgaccagcccattgacatcagtcgtgaattccttgctatagcctttgtcatttgtcagtcggaaaatggcccctgctaagacttgattgctatcagcagcatccaccttcttgatgacgagtgaattgatctgatagttggcagcctgtacagtaaccggctgctgcttattctggcttgctagcgcgctcacggtttgcgtcaggtcggtttgttctactttaaagtcgatcttatcggtattcagttcatatttcggcaaggtcttggtttcttcaaagtagtagtcgccgattggcaagttaaacggcaggttgatctgcccgacttcatccgtgacaagatccttggcaagaacattgccattgctaccatataagtcaaaggtaatgccggccaaatgattgccaaaattaccatccgtcttttgcagctgaatggcgcgtttaaattcgggttcgataatcggatcaagagcaactttttggtcgcccttgacgttcacatcaatccccttggccagatcatctgggataacgtagccgcgtggtgcctgcgtttcaaccagcagatacttaccttcataaagatcatgatcattgaaggtcacaatgccattctggttggtgatcgttgtggtccatgcgtgactgtgatcaaccgtgccgtcttcacgataacgatacatcgcaaattgggcgccaatcatggtcattttgcccgggaaacgatcatcggttgtggtgtccgccttcttcgtcacaatgatttggccagccttcttctggttagttgcggtcagcttcagctgtgtttgatcagtcttgatggtgaaatcgacactaccagcggccaaactatcttcccatcgttgcttctggacgccgcttgtcgcgttagcttgatcagcggcatccccttcataatgctcaggggcttgggtttcgactaggcgatatgaattgtccggtttcaacccttcgatcgcgtattcgccatccttgagtgaggtgtcaaagctgcttgctgcgccaaaggtcaattgcccatcagtgttggtcttcatgtcggccttcaacgttttgttggttacggcatccacaagcttatacgtcgctcccggcaacagatactgcttgcgtgttgccgcatcatcggtcttcttaacccggttatcgtacttagttaaggtgacttgataaggatcgtcagcaatttgcttgtcgatggtgattggtgtcggcgtgatcgctgaggatagcgtgatcgcatgaaccgtcttgtccaatcgatacccagccggtgccttcacttctgtcaacgaatagctgcctagcaacagatcgccaaaagaggccatcccattttcgtcagtggtgatgtcacggctgtagccagcactgttggtcaatcggaaaatcgcccctggcagcacatgagctgcgtaattgcggtcaaccttttgaacattcagcgttttgacttgatagttggtgacattgacgcgaatcggttgttgcttattttcagttgccaaactgcttgccgtttgcgtttgatcagtctgcttgacttcaaaagcatatttgtccgtatttggccgatatggtggcaaggtcttcgtttcctgaatataatactggcccgctggcaaagtgaacggcaagttgacctgtccattttcatctgtcactaagtccttggccaactcagtgccgtcatttcgatacaaggcgtacgtaatgccagcaattggattaccaaagttaccatcggtcttcgccacacttgccgtccggcggtaaaccggttcggtgatggttggcagcgttaaggtttgatcgccagtgatatcaacgtcaacgcccttgccagttcatctggaatgacatagccatcaggagctttggtttcaaccaactggtacttgccttcatataaatctgaatccttaaaggagacggtgccgtcattgttagtgatggtagcgtcccatgaccggctgcgatcaactttgccagcttcgtcatagcgataaagcttaaattcagcgccagtcattggttgacgatcagggaagtgatcatccttgatggtttcagcttgtttcttaagatccagctgacccggtttcttttggttcgttgcggtcagcttcacttgcgtctgatcagccttgatagtgaaatcaacactgccagccgctaagctgtcttcccacgcctgtttctgggtgccgcttgtcgcgttgacttggtcagcagcatccccttcataatgttcaggagcttccgtttcgaccagccgatatgaggtatccggcttcaacccttcgattgcgtattcaccatccttgagcggtgaatcaaaactgcttgccgcgccaaaggtcagttggccatcagcattggtcttcatgtcggcctttaaggtcttgttggccgccacgtcgacaagtttgtatactgcgtttggtaacagatacttcttttgactcaccggatcatcctttttgacgcgattatcatacttcgtcagattgacctgataaggatcgtcagcaatctccttattaaccgtaatcgctgtcggcgtttcggcagaggacaacgcaattggataaacggtgttgtccaaccgataccctgctggtgccttgatttcagtcagcgagtaactgcccaacagcaagtcgccaaatgaggcaatcccattttcatctgtcgtcacgtcgcgagtgtaaccagcactattcgtcagccggaagacagcccctggcaacacatgagttgcgtaagtgcgatcaacctttttgacgttcagggttttggcttgataattggtcacattgactttaatcggatgctctttgttttcggtctccaggttgcctgccgtctgggtttgatctgtctgcttcacttcaaacggatgcttatcgctgtttggccgatatggtgtaaactcttggtttcctgaatatagtacttgccggccggtaaattaaatggcaagttgacctgtccattttcatctgtgactaagtccttggcgatctcagtcccatcgttttgatacaacgcgtacgtgatgccggcaattgggttgccgaagttgccatccgtcttagccacttgcaaggcgcgtcggtaaactggctccgtgatcgtcggcagcttcagcgtctcgtcaccagtgatattaacgtcaacacctttggcaaggtcatcggggatgacataaccttcaggcgctttggtttcgactaactgatacttaccttcatacaaatcaggtgaatcgaagataaaggtaccatcttggctaatgatcgttgcgtcccaagatttgctttgatcaaccttgccgtcatcgccgtaacgataaagcttaaattcggcgccggtcattggctggcgatcagggaacttgtcgtcagtgatcgtttctgcctgcttcttgatatccagttgaccaggtttcttctggttatacgccgtcactgtagcggacggcgccttgttagaaatgatcgccgccacgctgccggctttcagactatcttcccaaacctgcttgtcgggtccgctggtaatcgtcgcttgatcatgcgcatccccgcgataatgatctggggcttgcgtttcaaccagcttgtaattgcctggcttcaagtcttcaaggacgtattcgccatctttcaagtcaggggtgaacttgtcgccagcatactgacctgaaaagctgctagccgttccgatagtgattttgccgtcagcgttggtcttcatgcccgacttcaatgttttctgcgtatcggtatccactaagtcatacgtggcgccgggaagcagatagtgtttgttatctgtttctgattggcccttagcgcggttgtcatacttcgacagcgtgatctgataaggctcgttttcaaccgcttccgtttgaatcgccgtgcctgtatcggaagttgcgttcagatgaatggtctgtggtgccaatggcttataccctgctggggtactgagctccgtcaacgtatagtcaatcccaattggcagtccttggaaggttgccagtgccttattcgtggccgaatcaagttttgtggtggcttcaaatgtatgggtgccgtcacttaagcggaacttaacgcccggaattggcgtgccactgacgctatccttcttttcaaccactaagttggctaattgcgtgagggtctcgccgctgatacctgaaccccaataaggcaaatacccatttgcgtttgcaattcgcgcatcaggagggacaccatcacttggcttttgagtcgtttggctgccatcccattcaacgctactcgaattgtatgcccatcctgagttcttgctactggtggcatagtcgacgcttacttggtaattattaagtgggctattggtctcttgcgtcagattcccaaaagttcgcttaaaggtaatcgtaaatttattgccatctaaggcaagggtataatcatccccttcttttaacgtaatcggatcggcaatgccaaccttcaatttcactacaaaactggtagcattgatttctgctccagtacctcttggatccaaagtatcctcaatgactggattcaccattggtcgatacttgtcttggatattgatcaaattcactttccaattcaagacattttttagtttagtatcagcactaacagttttgctgatcggcgtccaataactttgtgccgactttgaggctgacggattgaacgtcggaatcgctgtggttggttcggtgtctgtcacagtggcattgttggcgaagttaggatcgttatagttccactggttagcgcgcatcgtcttgaaaacgacccaaatacgccccgtgccgatatttggaaaatcaaaatccaattgttgcgctaaatttggattgtttttgagccatgtatttggcgtgttggttggtaacagactttgctgagcagcatcctcagccttaagtgctgtcgatgaccaaccaccggttccataatatggactcgtcttgatttctttaacatctctggaagtggttggatccccactgttcgacggatcaaccccatctggtcccgtgacttcatagaatttaatcgaatcaggaatcaactcgtaattaacgccatcaaaccgcggcaaaatatcggtcaggtgcatgtggccatatggaagccccaattgattaaccaagacaccccaatactgggtatctggtgcgtcactccaagaattcttcaaggctccgctaaaggccccttcttctggtgttggtgtactactactatcaccgctggcaacgtcatcatcacctggtggcaagtcaaagaagaaaaatgcgcgattatttaaagcctttttcaaagcgtctgggtcgtgaccgacttggcctagcttcaacatgtccagcttagtatgcgtataaatcacaatttgcgaatctgtttctgcatacgcccctttgagcgtgacgacaaagccgcgaatgcctttttcctgaccattcgcattaatcggatttgtcttatccttgtcgttatattgcttaactgcagattgaacgtcagcgtcttgggtactcatatcgtaatcagtccccggcttcagcaacgttcttgcgccgtccggattctgggcgtagacaagaataccgtcattagcaccatcgtcaacatttgctgagacattttcaccggagatggtgttgatgttatcggccgttggatcgttgtccagcttatcgaccccatccgggaaaaggtcgaagattttaccattcttcatgttccggaaaacgcggttggcattgatccgccacgtcatttgaccattgtaggcatcaatcttgccgcctacttttgtaatcccgcttggcagcctaactggataggtcgcatgatcgtaatgattcttctgatcattcacaatattggttaagttgtcgccatttttcggtgtgttcttcagtttcgtttgatattgaatctggaaagaagcattttccgggagatcgccgccgccaagataagttagtgtgaactcgccgtcgcctttttcagtgagcttaaagtactgcgcgatgtcgaccttggaaacaatcggcgttgcccactcgtcaaacgtgacttgaaagaccttcagggacttcgtgtctaaggtttgattgccatctgtctcgatgttgggttgatcatgctcatctttcccgctggtttgcttaccaaagcgatccgttagcgtggcgccagccttcatggtatccatgctgtaattccaattaattttccagttaagtgctcggaagttattggtaatatcgccagatttggtgatcgctacaccggagttgcgcatggtgacactatcatagtcataaccgtcagacgactgtgaaccagttaagtaacgatagccttcaactaaggcactgcccactttcccggtatcgtctaaagatcggtcaatcgtggccgtataatctacctgatacccagttgtttttttaaagccgcctgtcagataaattttaaccgttcgtttgtcatccgataaaacagcatgaaaatcttggccggcgactaacggcttaagttcttcagaaaagccgccgagaatattgactggtgccgacgagaccttgatcttcgccagatcgctgttgctaaaggtcagcgatttgagataatctgttccgctgcctcgtgccgtcagtgtcaatgccatgtcagcgttctttgaccgtttagccggatcactgtcccactttgtcggatcggttttgctggtttcgttcccgtttaaattaaacttcgcggtcccagcaatgccagtcggattcaagctttgtggtgtcgtcgtaggcgcatacaccaccaccggcttggcattcgacctaaacgtgattggaaactttgtgtcctgatcttttgtatggaaaaccagtgtctgattgagtgaatcattagcagttaaagccttaaagcttgctgcaatatgcactaaccaagaaccattactcgtggctttcaaaagtttgatcgtcagctgtcctgtggttgcgtcaaaatagtacgaggcgacatcaccggaaaagttgccgccgccgctttcaggaaaagcaatctgatcctttggcaaggtcgttgtaaaggatgcccctgccggaaacggggtgctcgttgccggtaatgtaaaggtcatctccatcttcacagcactttgctgatcgacttccgttcccaaaggctgatcattgccgtccttcagcgccaccttcgtgaaaatattgggcagctcagtatcggcctttgcgtccggtgtcgcgcttttttcagcttctggcgtcttcgcttccgctggttttgcggctgtgctactgctactgccgctatcaagtgtggctgatgcgcggctcttaaacagtagtgtcacattgcccgatgccgtgacactgaaatttttcgtctgctcaagagctgtgtaaccggaaacagactgtttttcggttgccgtgtaatttccgaccggcaagtttggtaccgtcgcctggccgtccttactgatctcgctattcgccactacctgatgcgattcattttgaatctcatacttagcgccgtttagcggtgatccttgttcatcttggttcttgatcgtgagcgtaccagtcactgcctgtgtcggattttcggctgcaagggctagtgctggcgaaatcagttgtacaatcatgccaaggatcaccgttaagtaaatccccactttgagcatgaagtgcccggttttcttgccacctaactctctcatttctctcctcttcctcctctttacaaacctacttggtatctccccctgagaccattaacctatagtttatggatacattaatttacactccgctcaatatcattgtataacatttctataaatattgaagggattataaagaatattcattaaatatatatgcttatgtttattcttttcgcctagtggtgatttgcttttaaatccttacatatcaggtgttgcagccaattaaaaaatgtactgttagacaggtttattaaatatcgattttcccagaagttgacagcgttaacaatagagcttttttagcccattatcatctgctttttacttgtgtaagaagaaaaacaaatgcgaaatctgcttcatgaagaggtgaatgctatgctaataaccgtacttttgctcattgttctgtacttagttcgccagcacagcttggaaacccgttgctttcactgtctattagccgtcctctctggattaagcatccatacttggttaacttttttgcttgcctcaggcttaatcatctttagcgtggctgactggcatgagcgaacggttcctttcttcagctttactggttggtgtttgactttgctggtttgttttccccatgaccttttcggcatgatgctacttgctgtcatgattggcggtttagccgttgtgtcgcaagggcttgggagtgcggatgtgatgttaattgccttgctggcctgcgttttacgactcgaggcagcgttaatcgtgacactgattgcttgcggaaccgcctgcctgcattggatagctgcccgtccgccgagtttgccaatgatcagtcatttagcggctggttatgcgtgctttgctttggtcaatggcggactataacgcgctcgcagtcgcagaaacctacacgtaaggaccttgaagctcagtgaccaccccatgtcaatgagcttcaaggccacttacgttccagtttctaaacgctcctactcgcgctcaccaaaaaagcggcgcaagcatcttttcagatgtttacgccgcttctttttggtttaactgtcagctcccgcgattactttttgtccgtatcgccttgctggccgtcttttgctttcatttgcttttcgatgtctgaaatcgaatagacactgtcggaaacggtgccgacactctttggttcttcgtgtcgatacgttgccatcccggtaccagccggaatgatcttcccaatgatgacattttccttcaaaccgatcagcggatcgttcttgccgcgaatcgaggcatcggtcaatacccgtgtcgtttcctggaaggaagcggcagacaggaaactgttggtctccaaggaagccttggtgatccccagtagaactggccggccagtagcagggataccgccactgataattgcctgcgtattcttttccttaaagtcagcaatatcgagtaaggttcctggcaagatgttggtgtcgcctggatccatgacccggatcttgcgcagcatctggcggaccatcacttcaacgtgcttatcgccgatatcaacaccttgcatacggtaaactttctgaacttcagaaagcaggtaattttcggtggccatgacatcgcgcactttaatcaattgcttaggatcaatcgaaccaccagtcaggcgttcgccacgattaatgtggtcgccttcagcaactgccacactggaagcatatggcacgctgtaagtccgggtgtcggtttcacctttgaccgtgatttcccgtgtatgctcagctggattttcgtcaatcgccgtaatttcaccggtcacttccgtaatcacagcttcacctttagggttacgcgcttcaaagatttcctgaacacgaggcagcccttgcgtaatatcttcgccaccggcaacaccgccagtatggaagttccgcatggtcagctgggtaccaggttcaccgatagattgcgcagcaacagtcccgacagcttcgccgacttcaacttgttcgccagtggccatgttacgaccgtagcacttctggcagacaccatgtttggtgttgcaagtgaagaccgaacggatcgtgacggattcaaccccggcatccacgatcatctgagcagtatcttcgtccatcaaggtattgcgcttgacgagcacttcgccactcttcggatccaacacatccttcatggtgaaacgaccaaccagtcgatcatacaacggttcgatcatttcattaccttcacggatagcactgacaactaagccacggtcggtaccgcagtcctcttcacgaacaatgacatcctgtgcaacatcaaccagccgccgagtcagataacctgaatcagccgtcttcagcgccgtatcggtcatccctttacgagcaccgtgagttgacatgaacatttccatgacggacaggccctcacggaagttcgagataacaggcacttccatcatcccaccgtttggcgcagccatcagaccacgcatgccggcaagctgtgtaaagttagaaatgttaccacgagcacctgaatcggacatcattgaaattgggttgttcgggtcaaacgaatcaaccagcttttgctgaatatcatctttggcatcattccagatctggataacccgatcatgccgttcctcgtcggtaatcaacccacgacggaactgcttggaaacagtggcaaccttcttatgggcagcttccacaatttcaggcttttccttcaagttagtaatgtccgcgatcccgacagtcaagccagagttagtggactgcgtatagcccaaagtcttcatatcatccagcaagtcactggtccgttgaactttatagaccttgaagacttgcgcaatgatgtcagacaggaagcctttcttgaatggatcgattaacggtgcatcttcaaggtagtcgttgatgtcttcacccttatcgatgaaatacttatccggcacaccattgacgatgttatcctgcgtcggttcattcaaatatgggaagtctttcggcataatctcgttaaagatcgccttaccaacactggtgaccatgatcttttgtttctgatcatcggtaaacggcttgtccgtaaaggaattagtcgcaatcccgatgcggctgtgcaagtggacataaccgttttgcaaggccatcaacacttcgttggtgtccttaaagatcatgccttcaccttcgcggcctttttgttccatggtcaggtagtagttacccagcacaacgtcctgtgatggcgtaacgattggcttgccatcttttggtgccaaaatatggtgtgcagccaacatcagcatccgtgcttcagccatagcttcgtcagatagcggtacatggatcgccatctggtcaccatcaaagtcagcgttataagcttcgcagaccagcgggtgcaaccggatggacttcccatcaacaaggacaggttcaaatgcctgaatcccaagtcgatgcaaggtaggtgcacggttcaacagcactggacgttccttgatgacatcttcaagcacatcccaaacatcatcatcttggcgatcaatcttgcgacgagcattcttgatgttgctagccatgtcgcgcttaaccaattcgcgcatcacaaatggcttgaacagttccaatgccatttcacgtggtacaccgcattgatagaacttcagccatgggccgacatcaataacggaacggccggagtaatcgacacgcttaccaagcaagttctgacggaaccggccttgcttccctttcagcatgtgtgacagggacttgagcgggcgattacctggccccgtaaccggacggccacgacgaccattatcaatcaaagcatcaaccgcttcctgcagcatccgcttttcgttttgaacaatgatacttggcgcattgagatcaagcaggcgcttcaaccgattatttcggttgataacccgtcgatacaagtcgttcagatcggaagtggcaaaacggccaccttcaagttgaaccattggccgcagatccggtgggataactgggatcgtgtccatgaccatccaagctggatcattaccagattccttgaaggcatccagaatatccaaccggcgaatcgcacgggtccgcttttggccttgggctgacttcaagtcttcctttaattcggcaacttctttatcaagctcaacatcctgcaacaattccttgatggcttcagcacccatcttggcattgaaggtttgaccgtattcttcgcgtttttcacgatattcacgttcggtcaggagctgctttttctccatcggcgtatcgccaggatcgatcacaacgtaggatgcaaaataaatgatctcttcgagtgaacgcggtgacatgtccagtaccagacccatccgacttgggatgcccttgaagtaccagatgtgggtaaccggtgcggctagttcgatatgacccatccgctcacggcgaaccttggaacgagtaacttcaacaccgcagcgatcacaaacgattcccttataacgaatccgcttgtacttgccacaggcacattcccagtccttggtcggtccgaagatacgttcatcgaacaagccgtcccgctcaggttttaacgtccggtagttgatggtctcaggttttttaacttccccataggaccagctacggattttatctggcgaggctaagccgatttgcatactttcaaacttattgacatcaatcaaagggctaacctcctatttcttatcgtcggtactgttggcagacttaccgtcagttgcttgtgctgcggcttcgtgagccttcttttcttcctgctgagcagcaaacttcgccaaggcatcgacagaaacaatatcatcctcgtcgtcgtccatgtcccgcagttcaatttcttttttatccgcgccaaggaccttcatatccagacccagtgcttgcaattctttgacaagcacacggaaggattctggtacacccggcttaggaatcggttcgcccttaacgatggcttcataggtcttaacccggccaaccacgtcatcggacttgtaagtcaggatttcctgcaaagtataagccgcgccataagcttcaagggcccaaacttccatttcaccaaaacgctgaccaccaaactgagctttaccaccaagtggctgttgggtaactaaactgtaaggtccaatggaacgagcatgaatcttatcgtcaaccatgtgagacagtttcatgtagtacatgattccgacagaaacacggttttcgaatggttcaccagttcgaccgtcatacaagacagacttaccatcagatgccataccggcttccttaacggttgcccacagatctttatcgttggcgccatcgaaaacaggcgttgcaacatgaatgcccaagttacgtgcagccatccccagatgcaattccagcacctgtccgatgttcatacgacttggcacacccattggtgacaagcagatgtcaactggggtaccgtctggcaagtatggcatgtcctcttcaggcacaacgacggaaaccgtccctttgttcccgtgacgaccggccatcttatcaccgacttgaatcttccgcttctgcgtaatataaacgcggaccatcatattcacaccaggagacaactcatcgccggcttcacgagtaaagatcttaacgtcttgaatgatcccgccgccgccatgaggaacccgcagcgaggtgtcacgtacttcacgtgctttttcaccaaagatcgcatgcagcaaccgttcttcagctgacaattcagtaacgcccttaggtgtaaccttgccgaccaaaatatcaccgtcacgcacttcagcaccgacacgaacgacaccaaattcatccagatccttaagggcttcttcaccgacgtttggaatttcacgcgttacttcttcaggtccaagcttggtgtcacgtgcttcagattcatattcttcaatatggattgaggtgtaaacatcatctttaacgagtcgttcggagagcacaatcgcatcttcgtagttgtacatgttccaagtcatgaaggcgatgatcgggttttgtcccaatgccaattcaccattttgcatggctggtccatcagcgatgatttcgtcaacatcaacatgatcgccgatggtcacgattggccgctggttgtagtttttaccggcgttactacgcttgaatttcatcaagttgtaggcatccaaggcaccatcttcacgacgaacccgaatttgcttagcatcaacatattcaacggtaccagcgttattagccaaaaccgctgtcccggagtcatgggctgccttgtattccatcccagtcccaacaagtggggcatgcggattaaccaacggcacagcctgacgttgcatgttcgcacccatcaaagcacggttggagtcatcgttttccaagaaaggaatgcaagccgttgcgaccgcaacaacctgtttaggcgaaacgtccatgtagtcaactttgtctggagagatttcaatgttgttatccttgtgacgagccagaacggtttcgtcaacaaaggaaccatcgtcgttcaaaggcgagttcgcctgcgcaacgatgtagttatcttcttcatcggcagtcaaatagtcgattttgtcggtaactttatgcgtatcccaagaaacacggcgatatggcgtttcaataaaaccataaggattaacaaccgcataagaagcaagactgttaatcaacccgatgttcgggccttcaggcgtttcaatcggacacatacggccataatgggtgtagtgaacgtcccggacttcataaccggcacggtcacgcgtcaacccaccaggtccaagagcagacagacgacgcttatgcgttaactcaccaagcggattcgtctgatccataaactgcgacagttgggaactgccgaagaattccttgatagaagctacaactggccgaatgttgatcaattgttgcggtgttaccgtagcggtatcttgaatggacatccgctcacggacaacacgttccatccgagaaagcccgatccggaattggttttgcaacagttcaccaacggaacgaatccgccggttacccaagtgatcaatgtcatcaattgaacccaagccttcctgaagattcaggaagtagttcattgatgccaaaacatcagctgggacgatgtgcttcacttttttaccaatatgaccgttaccaatcaaattgatttctttatcaggggtcacttgtgagtaaactttgatactctgtaattcgatcggatcagtgacaacgccttgatcggaaggttggtaggtgatggtcttgaaatcgtcgcggtcaagatatggtgccaacttgtccatcacttgacgatcaaccttggtgcccttttgcgcaatgacttcaccagtatcaggatcggccagtgtttctgccaaaacctgattcaaaagccgggtcttaaggctcagcttcttattcactttgtaacgaccaaccgaagcaagatcataacgcttcgggtcgaagaagcgggcatacaaaagagaccgcgatgaatcggctgtttttggttcgccaggacgtagacgttcgtagatatccttcaacgcttcgtccgtacgggaatcatccgtgttcttatgcacatctttttcaagcgtaagcatcaaggaatcattgtcaccaaacatgttgataatgtcttgatcggaaccgaagcccaacgcccgaaccaattcggtcagcggaatcttccgtgtccgatcgattcggacatacgcgatatctttggcgtcagtttcatattcaagccaggcgccccggttaggaatcacggttgtgccataagtgacacgtgagttcttgtctgtttcgctatggaaataaacgccaggtgaacggaccaactgagaaacgatgacccgttcggcaccattaataataaacgtcccttgtttggtcatcagcgggaagtcgccaaagaacacatcttggctcttaatctcgcctgtttcatggttggttaaacgcaaggtcacatgcaacggtgcagagtagtttgcatcgtgttggcgtgcttcctcaacagtatattttggttccagcagttgatagccgacaaattccagtgacagtttcccttgaaagtcatcgatcggcataatatcgtcgaacatttctttgagaccttcatcgaggaaccattggtaagaattcgtttggatctcgatcagattaggaagatccaaaacttccttgatccgggcataggaccggcgtgtccggtgcttaccataattcactaagtgtcctgccaaattattcaccccttgtaagattttccggcttaggttgattgtaaaaataatgtaaacattgttaaatttacatgacaacgaccatcccgcagacattttgagcaaaaaaaaaccaaaaacagatcgaccttcaaccagcctgctgtttttgctttttcattagtcagaacggacaatagatcgtcctgacagcctgtccaaaccgaaatgcgattagattcataatacgcgtatcaatcaacgatgtcaagcggaggttgatccgtgctgcgcaagcaaagccaaaaagaaatcgcaacctatcagccgcgatttcttcattatcaacactaggctttaacgggttcttttgaagcaccgttttctttttgcttgcctttgttctctttaacagtaaatgtcagcttgccttttttagcaccgatttggatcaagtcaccggttttagcttggcctgtcaataagagttcacttaactgatcttcgacaccggtttgcagtgcccgccgaattggacgtgcaccgtactctggatcgaagccggcagcggcgacagcgtcaataccggctggggtaattttaacgtcaatcccttgatccttaatgcgactaagcactgtcttcgtcatgatcttaacgatttcatgcagctcagccttgttgagactgtggaagaccacggtttcatcaattcggttaaggaattctggtcggaacgcttttttaagttcgtccagcatccggctcttcatggcgttaaagtcagcttgtggatccttggcaccaaagccaacagtcttatcgtcacgaatagcggttgcgccgatattactggtcatgatcaaaatcgtgttacggaaatcaacccgccgaccttttgaatcggttaaatagccatcatccagcacttgcagcaaaatgttaaagacatctggatgcgccttttcaacttcgtccaacaacacaaccgagtaaggcttgttgcggactttttcggttagttgaccgccttcgtcgtaaccaacgtaaccaggggccgcgccgatcaaccgactggtactaaatttctccatgtactcagacatatcaacccggatcatggcatcttcagaaccaaacattgcctcggctaacgccttagccagctccgttttcccaacacctgtcggcccgaggaacatgaaggaaccaattggccgcgtcggatctttcaaaccagaacgagcacgccggatagcacgcgcgacggcggaaactgcttcgtcttggccaacaacccgctcatgcaggatcttctccaagttaaccaaccgatcggattcttttttctgcaactgggtgactggcacaccggtccattgagaaaccacttctgccacatcgtcgcccgtcactttaatgtcagttcgaacgccactttcattaactggttcaggcgtgtcggccaacttcgtttttaaatcagcttcctgagtccggatgttcgcagccgtttcgaaatcttgatggtcaatagcgtcttctttatcagctaccagcttggccagttcatcctgaagcttatcggccttcgtctcaacattggccttgtccaagcgaaccttcgccgcactttcgtcaactagatcaattgccttgtcaggcaagaaccgagtcgtgatgtaccgtgatgacaaaaccaccgcctgatgcagcgcttcgtcagtaatcgtgacaccgtgatgcgcctcataacgaggacgcaagccctccaaaatttgttcagcttcttcttcagttggttcgtcgacttgaatcgtcgcaaaccgccgctccaaagcagcatctttttcaatatacttttgatattcatctaaggtcgtggcaccgatcaattgtaattcaccacgagctaatgccggtttcaaaatattggaagcatcaatagcgccttctgcaccgccagcaccgatcaaagtatgcaattcatcaatgaacaaaatgacattgccatctttataaatttcatcaatgatcttcttcagccgatcttcaaactcaccacgatacttggtaccggcgacaagtgagcccatatcaagcatcatcaaacgcttgttgaccatgtcatcaggcactttaccagacacaattttctcagcaaagccttctgcaattgcagttttaccaacaccaggttcgccaatcagtacagggttgttctttgtccgccgtgccagaatctggatcagccggcgtacttctttgtcacgcccaacaaccggatccatccgattctcgcgcgccatttgagtcaaatcccgcgccaaaccatctagcgttggcgtaccttgtccatcttgacgagcaccgccacgtgccattgggcgacgctttgctgcagtgtccgcaatccccatcttcttgaaaaccatctgacgcgtcttcgaaagactgagaccaaggttttgcaaaatccgtgctgccaagatgtcatcttcacgtagcaagccaagcaaaacgtgctcggtaccgatctttaaagcacctaaccgttttgcttcgtcacctgcaaacgccaaaatctctttaccttttggtgagtaaggcaaataactatcactagcttgaccagcggcatcaacagtcccataccctgtgaagcgctcgatctcgtcatggacatcattttcagtgacccctaactgacgcagcgtcttaccagcgataccatctttttccatgaccagtgccatgagcaaatgttctgtcccaacagcatgatgatggaagtacttcgcttgttcctgggctaaaagcaatacatttttagcactaggggtaaataagttgtccataagcacgctcccttttttaaaaactgatgataaactgtttcatctttcataccgcaaacgatccaaaaatgcaaggaacaaacgcgatcgtagatgctcttctgccccttgatcgaagatgcccaatgtctcatgatccatcaccgcgagcatcaggttgccagactggcgggcgatcaacccgttatcaaacaattcctgaatcaaatctcgggcatcccgcatccgcaaacgacttggaatatgctgtcgcatgatctgaatgagatcctgatcatctgtcaatttgaccttcacgattcgaatatagccaccgccaccacgtttgctctctacgatataaccgcgagcaggtgtgaatctggttttgatcacataattgatctgtgaaggtacacaattgaaacgacgagcaatttcagcgcgtctgatttcaacagccgcttcttgcgccaatatcgtttttagataggtttcaatgatgtccgaaatgttctcacgctgcatgtcattcaatcctttttgactttgaccaatcttgactattacacattatactgacatctgtccgtttatacaaatttatgactttgaacgcaaaaaaagaccacgactattcgtgatccaagaatcgggaagacaagattcgaacttgcgacccctacgtcccgaacgtagtgctctaccaagctgagctacttcccgaggaagcggaagacgggattcgaacccgcgacccccaccatggcaaggtgatgttctaccactgaactacttccgcattccgagtatttagttctaatcggcgccagcttagtagcggtcgatgatgcacccagtaggagtcgaacctacaaccttctgattcgtagtcagacactctatccaattgcgctatgggtgcattcaacaaaatgccgaggaccgggatcgaaccggtacggtcatcactgaccgcaggattttaagtcctgtgcgtctgccaattccgccaccccggcataaagtgaaaagcggaagacgggattcgaacccgcgacccccaccatggcaaggtgatgttctaccactgaactacttccgcataccgcatattcaattattgagaccggggagaaaaaaccacctattggaaccgagcttttacttcacagtacaatgcgggtgaagggactcgaacccccacggtcaaaaaccactagaacctaaatctagcgcgtctgccagttccgccacacccgcaaaaggtgggttaaaaatgagccgtgacaggctcgaactgtcgacccactgattaaaagtcagttgctctaccaactgagctaacggctcaatggaggatacagggctcgaacctgtgaccctctgcttgtaaggcagacgctctcccaactgagctaatcctccatatgtaagcgtggcagcttcctaccctcgcaggcagtttcccaccaactactctcggcgtgaagaagcttaacttctgtgttcggcatgggaacaggtgtatccttcttgctatcgccaccacacttatgagaactttgcgctctcaaaactggctatcattgtttaattgctgccttgaacttaacgtacttgtcatcgaaacgtgttcgcagtcgcagaaacctgcacataaggaccctgaccgcaatggccaaagcccggccatcacgctcaggcccgcttatgctccggtttctaaccgctcctgctcacactcttacttggttaagtcctcgaccgattagtactggtccgctccatgcatcgctgcacttccacttccagcctatctacctgatcatctctcaggggtcttacttccatataggaatgggaaatctcatctcgaggggggcttcacacttagatgctttcagcgtttatccctgccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacttgtcagtctcgcagtcaagctcccttatacctttacactctgcgaatgatttccaaccattctgagggaacctttgggcgcctccgttacattttaggaggcgaccgccccagtcaaactgcctacctgacactgtctcccgccacgattagtggcgcgggttagagtgttcatacagctagggtagtatcccaccaacgcctccatcgaaactagcgttccgatctctacggctcctacctatcctgtacaagcggtacaaacactcaatatcaagctacagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactataatttcgctccccatcacagcttgtccttaagactgcaagcatttcactcgctgtcagacttgctgcttgggcgcacatttccagccgtgcgctttccttagcctcctgcgtccctccatcgcttaaacaaaataaactagtgcaggaatctcaacctgcttgtcatcgactacgcctctcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcacccttacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcgatggtattcggagtttatctgaattcagtaacccttgatgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctgcttactcattcgccctgttcagactcgctttcgctacggctccgacttttcatcttaacctcgcaagcaaacgtaactcgccggttcattctacaaaaggcacgccattacccattaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctggacggagggttcgacgtttcgcttacagggctttcaccttctgtggcgcagctttccagctgacttcgactacgtcggactttggtaactccaatgtccagtcctacaaccccgagaagcaagcttctcggtttgggctcttcccacttcgctcgccgctactatgggaatcgagttttctttctcttcctgcgggtactgagatgtttcagttccccgcgtctgccgccggccagctatgtattcactgacaagcaatacactgatgtgtactgggttcccccattcggaaatctccggatcaaagcttacttatagctccccgaagcatatcggtattagttccgtccttcatcggctcctagtgccaaggcatccaccgtgcgccctttgtaacttaacctgtactgacttgcgtcagcggttatgcgatgcgaatttctttttcagaaactcatacaaatacgctgtgttctcggcaatttaaaacaattaatacaatgatatccagttttcaaagaacaaagtagccgactttcgtcggtcattggcctttcggccaatggaggataacgggatcgaaccgatgacctcctgcttgcaaagcaggcgctctcccagctgagctaatcccccataagggttgttcaattaacaagcgtacgcttgatgggcctagatggacttgaaccatcgacctcacgcttatcaagcgtgcgctctaaccaactgagctataggcccgataggcgtgaagaggttatcctctcaaaactaaacaaagtttcgtgtgtgcaggtttccgtcagactttcagtctgtttccttagaaaggaggtgatccagccgcaggttctcctacggctaccttgttacgacttcaccctaatcatttgtcccaccttagacggctcgctccctaaaagggttacgccaccggcttcgggtgttacaaactctcatggtgtgacgggcggtgtgtacaaggcccgggaacgtattcaccgcggcgtgctgatccgcgattactagcgattccgacttcgtgtaggcgagttgcagcctacagtccgaactgagaatggctttaagagattagcttgacctcgcggtctcgcaactcgttgtaccatccattgtagcacgtgtgtagcccaggtcataaggggcatgatgatttgacgtcatccccaccttcctccggtttgtcaccggcagtcttactagagtgcccaactaaatgctggcaactagtcataagggttgcgctcgttgcgggacttaacccaacatctcacgacacgagctgacgacaaccatgcaccacctgtcattttgcccccgaaggggaaacctgatctctcaggtgatcaaaagatgtcaagacctggtaaggttcttcgcgttgcttcgaattaaaccacatgctccaccgcttgtgcgggcccccgtcaattcctttgagtttcaaccttgcggtcgtactccccaggcggaatgcttaatgcgttagctgcggcactgaagggcggaaaccctccaacacctagcattcatcgtttacggcatggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtttcccagtttccgatgcgcttcctcggttaagccgagggctttcacatcagacttaaaaaaccgcctgcgctcgctttacgcccaataaatccggataacgcttgccacctacgtattaccgcggctgctggcacgtagttagccgtggctttctggttggataccgtcacgccgacaacagttactctgccgaccattcttctccaacaacagagttttacgacccgaaagccttcttcactcacgcggcgttgctccatcagacttgcgtccattgtggaagattccctactgctgcctcccgtaggagtttgggccgtgtctcagtcccaatgtggccgatcaacctctcagttcggctacgtatcatcgccttggtgagccattacctcaccaactagctaatacgccgcgggtccatccaaaagcgatagcttacgccatctttcagccaagaaccatgcggttcttggatctatgcggtattagcatctgtttccaaatgttatcccccacttaagggcaggttacccacgtgttactcacccgtccgccactcgttccatgttgaatctcggtgcaagcaccgatcatcaacgagaactcgttcgacttgcatgtattaggcacgccgccagcgttcatcctgagccaggatcaaactctcatataaatatgagctgttcgaatagctcgatttgttgttctagcgaattgacttcgcaaatgttacttcttgcctcggtaccgaagtaccaaggaccctgcacatttaaacgaaactttgttcagttttcaaaggacgaccttgtcaaaagacaactttgatatattatcacaagcaatcaatgcttgtcaataactttttttcatacctgatcggtaatcgttgttgctcatttacgacgctttttatcataccaacggtttgcgccatcgtcaacaactttttcaattaaaaatcgctctccgaatgttagcgaataatagcacaatattatccgtgatttgcgccacttatatcctggtgaccgtcatatctttcggaaaataaaaaatgccgccacaagggcgacatatcatgattggttatggccgcaatgttgggaacaaaaggacatcgcgaatggatggtgcatcagtcagcaacatgactaagcgatcaatcccgattccgagaccaccagttggcggcatgccgtattccaaagcttcaacgtaatcgtcatcgataccttgtgcttcgtcattaccagcactcttttcagctgcctgcgcttcaaaacgctggcgttgatcaattggatcgtttaattctgtaaaggcattggcgtattcaccgccaccaacaaatagttcaaaacgttcaacaaaccgcgggtcttttggattcttctttgccagtggtgaaacctcgattggatggcccgtgatgaaggtcggctgaatgagcgtctcttcgacaaactgatcgaagaaggcactgataatatggcccaccttccaataaggttcatagtgaacatcatgttcatcggcaagtttacgcgcatcatcgacactcatttcaggccagaagtccacgccagtcttgtctttaatggcgtccaacatattaatccgggcaaacggtgcgtccagatcaatcgccattccctgataggtgagcttcccggtatctagcaccttatgcgcagcaaaccggaaaatcccttcagtttcggtcataacatctgtcaaatcccagtaggcggcataagtttcaagttcagtgaactcgggattatgcttggtatcaatcccctcattccgaaaaactcggccaatttcataaacacgttccatgccgccaacaattagacgctttaagtgcagttcaagagcaatccgcaaatataaatcaatatcaagtgcattgtgatgagtcacgaatggacgagcattcgccccgccagcctgattgtgtaagactggtgtctcgacttccaagaaaccattgttgtccaagtattcacggacagcactgacaatcttggttcgcttaacaaaacgatcaaagctgtcctcattagaaataagatcaaggtaacgcttccgatacttttgctcgacatcggtcaggccatgccacttatcaggtaatgggcggagtgccttagcaagatgggtcacatggttggctttaaccgtcagctcgccagaatcagttttcatgacttcaccgctgataccaagaatatcgccaagatcggcctttttgaagatcatgtagttgtcatcgccaacgacatctttacgtacatagatctgcatcttcccgctacgatcacgaatatccgcaaatccaaccttgcctttgccacgtttagacatcatccggccggcaattgtcacttctggtttttcatccaacagtgtctctttatcatcttcaccgaattcttcgcgtactttcgctgcggtatgggtccggtcaaatcggtgcccgaatggatcgatgcccgcttcacgcaaggcttccatcttttctcgccgcgcaatcatttggtcattcatttctggttgctgtccgttatccttagccaacacatgttcctccgtttcaatttttaccactctttgatgatgacaattttacatccaaaaagcaacctactctaacaaaaagacactcgtcactgaccaacaaaagtggacaggcgtgtgtcaatgaaacaatgctaatttatgctttagcttgccgttcgcgggcgcgctcttcggtttgttcaacaaaatcatcaaagatgtgatcaacctctgcctgcgtatcaaccatgttcaccgcggctttggttttagccgagcgcggaattcccttcaagtagtaagctgcctgcatccgaaattcccgaacggcctgatgttcgccatgaaggtcaaccagccgttgtaattgcagctttgctgtcgcaattttctcgcgcggtgttggttccgggatcaattcgccgtcttccagataagccgacatctgtttcaatacccacggattacctaatgccgcacggccaaccataacagcatcagcaccaacctcgtctaacatccgcttagcatcttgcggggtgcggacgtcgccgttgcccatgaatggaatcgtgagatgctgtttgacttctttcaaaatgttccagtccgcatgaccagcataaagctgtttacgggtacgaccgtgcatggcaagcgctgcggcaccgcctcgttctgcagctaacgcattctgaacagcatagacatggttctcgtcccagccagtccgcattttgactgtcactggtttagagacggcatctgttacagctgcaaccatttcataaactttctcaggatctagcagccagtgcgccccggcatctgtcttcgtcactttagggaccgggcaccccatgttgatgtcaatgatgtcggctgccgtgttttggtccacaaacttagccgcattcactaaagtctctttggtaccgccaaaaatctgaatagaaatcggatgttcacgcggatcgacaaataacatattcagggttttttcgtttttatacatgatcccacggtcgctgatcatttcacagaccactaacccggcaccgaattctttagccgttacccgaaaggccgcgttagtcacacccgccattggtgcgacaactaagcgattcggaatttcaacatcggcaatatgccacatacaggccacctctttcttgcttgcgccttgctaactttacttaaaataagtgtcaactgcaactattcgtgtcgggccatcaaggcttccaagtccgccacactataatgatattgattgccacagaacttgcacgtggtttctgcaccaccgtcctgatcaatcatttcctgtaattgagcatgcggtagagttgccataatatcgccaaaatgttcttttgaacaattgcaggcaaattttaacggctgcgcatcaagaaattggactggttcgtcaccggcaattcgctgaataatttgctctggtgtcaggccgctttttaataattcagaaaccagcggtaatgttttgacgttggcttcaagttcagagagctccgcatcgttggcaccaggcaaggcttgcaacatgaaaccgccggccacctgaatcgtgttgtcggcattgacgaagactgacaggccaactgcggccggaatttgctctgacttggctaaataataggtaaaatcttctgccaactcaccagaaaccaaaggaacttgcccagtgaaaggatcgccgacgccaatgtctttcgtcactgctagtaagccacgtttgccaacagcccgcgcaacgtcgattttaccgaccagattcagcggcaagttaacgtgcggttcttcaacatagccgcgtactgtgccaacattggtaccatccgtgacaagtgcgccaacgggaccgtcgcctttaatgcgaaccgtcaacatatcgtctgcgtttttcagcccggaagccgctaacaatgctgtggcaacaagcgtccgaccaagtgcagccgatgaagcgctccaagtatcatggcgccgctgcgcttcacgcactgtttgagtcgcatcagcagcgaaaattcgaaaatgttcatcacgcgacaatgcgctcgcgatatagtcactcatgtagggtcctcttttctgaaaggtaaacgtggctattttaccagagatgggtgttattgaaaagatgcggctatcgtagtcgcctgaacaagcgtggataaataacttttatatttgtcgcaaagctctgtccatttctttccataaaaaataccccgcctttctatcagcgaggtattgattgttactaatcaaagctttggtcacgttcggcctatgtaccggccaagtgaaaagcttaagatgtcatttgaatttagttcaggcctgttgccaaagtccaagttaacgtggtttcgtacgtaccgttattaacgactgatgtcttaggcagcaccagtttgatattggtcttgtcccagccaaagacgttagcgccttcaccttcatcggtagccgcatgtgcaacctgatgattggtgtcagtgccactcaaagtcatcgttgttgttttgctgatgtcagtcaatggtaccaatgcaccaaccggcgtgaagccatcatcttgcgattcgttggtcaaaccgtagacattgccagtctggccataagccgtgttcagcatggtcaatgtcgcattgtcaatggtcttgccagtgtcggcaccattatcgtccttcaatgaaagcgggccatctgccttgacgctcagtgtccaatccccagctttactgttggtttggccagttttatcttcagcgctttcagcatcggtacgcatggtttgcttatcaacaaccgttgtccaagccttgcccttaacattagctaaagcggtgtcatcagtattaaggacagcggtcaagtttgtattaccgctcttataacttggatagcgagtattgtcagcccgccctgcgttttgtccgtcagcagtgaaaaccgggtaatctgagaagaactgttcgtggttaccaaagtccaaaatcttaggaaccatttgcagtcgcagataaccggtgttaccggttggcggcagttgaccaaaggaaatccccgcggttgtcttggcgtcttgcggtagtgcctgaccaccattaacgcctgcattaccttgaacagtagctgcttgcgttgccgctggggcagcgattgccaaaccggcaagtaaagttgcacccgcgaccaacgcacttgtcattttagtgaatttcattttgaaattcctcctcttaaaattttttacatcatggatttatccacggtataaaacagtttcaataagcgatagcttgacgatcagaacagattgaccgtcttccaggtattaaaatcgttgtatgtcttgatcgtaaagacaagacacgtcacaaaggcgatgagcagcaggatggacagaccaatccaaaaccacttgacgcgtcggtaggaaaatttagcgatcagtgctttcaacagcatcacctcctttgctgcggcgaacgtgccgataaataaagaaactaatcagtagtaaaacaaccaacacaattacaagtttgacccaaagccattttcgttgggcaatttggtaagcagttgccgaacttgtaaccagttcccctgaaccagtgattttgacgtaccgtgtgtcttctcttacctgtttgccttgtttcagtcgactcgtcagtttatattcacctgccactgatttttgtccggttatcagtcgtgttacatcaaagactgtttgtggcgcgattcgcggcaactcccgggtgacagttaatgagaaaaagcgactcgttgcgcttgtcagattaatcttggctgaaacatcctttaaaaaaattcgcttaggattttgtacttgagatcgcaactgaaatcctgatcgtttttgtaccaaagatgtctgccccatccttaagttgctaacgctgccagcaacatgaccgttgtgcaagacgaggccaagcgtataagcaattcggttttggacacttgtatctgttgttgatggtgctaaggctgacaagcgaattgctgacaaataagttcctcgtggctgccctttccccggcttcaaaacaattggcagttgtcgcgtttctcccggcttgagctcaaattgacgatcaatcttcactaagtcactcccggcgatcggtagatatttacgattcgcctgagtggcttttacataactaacaacgccattagctcctgtttgcgcatcaagaatttcggcattcacttttaagatttgtgcgctagcgttgtatgcctgtactgtaatggttcgtcgctcacttttaggaagatcgagatcgaagtagccagcgcctttaccaacatgattgtcactaggtaaaactggcgcgaccatcagtgcttgctggctgttagagacggtagcgcttacaagatttgtaaaagtaaacatgttcatcaaagcaagaccaagaacaccgatgaggactaatcgcaaggcttgccagtcgttcttcatcgtggacgaagcttgaaagtccatagcagtccccccagactggctaatagcaagacgcctgtcccgatcgttgcataaagccagtgattgactggtttattgatagcacgttcgttgatactcttagcctgaacgttactaaccttcatcgtcttcttaaacgtccagctcattggaaaacgattttgcgtgttcaagcctttgagtgtgaccttaatgtgataggtgccgggcttcattgattcataactccatgagactggaaagaccattttcgagttaggggcaatcatgaaattatcagctttgtacgttttaacatcgccgctatccatccccactgcaacactgacatttgcttttgagatcgccatcggttcaacattacgcaacgttacgccaagtgcgggatgtttttgaaataagattgggtttgtttcgtcatacttgacgttcggaaaaacttcgtaattctgcccacgtaaaaccaccccaactgagtaagcatagttcgagccaaccgcgttgccgccagattcgcctttatcgacatgttcgatgaaatgccaatcaccataaatcatgccatcatatcgctgttttggcattttgatggttgcactgatgaccttcatctgtttcggtgctaattgaatcgtggcgccacctttgtctaaggttgcaacggttgtaaatggcgttttcagacttcggtcaagattcttcgtgcttggtgtaaagtcgataccgccgccatcttgggtataggcgtttcgtaagtcgctcttgactgtgatgttcttatcagaaatattttgaactcgcatctggatggtgtgcgttgtatcttttgaatacaccaaatcaaaataattcagtttcatatttgcttgcgcatcaggcaaaaccggctgcacttcaaagtcagttgtttcggttttactggcggcggccacgctttgcggtgcgagaccgaccagtatgcatgccgcggcagcaatcagccaccgccctcgtttccattgcaaaagtcattcctcctatggtaaaagcgacaaattccaagtgagcgtcgtatgatagcgggtctgataccgtggtgtgcttgctggcacatgtaacccaacacttgtcgcgccgctatcgttgtcaccaaagttaatccgccatgtgccatatccgctattgtcatacaacgtcccggtcggatctttatcagtgctgccatcattgcgatagtgaccgctctttttaacttgcgctaaaacagttggactggtggctgtcggattcaaggaaaaatcgtcaggtgcttgataatccatcgtgtcttcctgcgcccaagttggatttgaagttgcatctgttcgtttcagtttaggattcatcagatgcagcgtcgcatcggtcaaagtttgagcaacctgtaagtttggatcttgactgtttggtttcggagttgacttaaattgaccgtcctgttgtacgctcagttgccaaccttgtgtgccgtagtaatcttcaaccgtgacgccaaaaggcaatggttgcttggtcgtgctttggttttccccaatgtaataggttcggtcaaccgacttattgtcaaactgaccaaagtcaagtgttggatcaacggtcagtttcagcatttgtttctcatagcgataagtcaccaccaaatcgtctttactgatcactggatcaaccacgctggcttgatcaaaagtcgcacttgtgagatcactggaagttgcctgatcgaccactgtataaccatcaattgcttttggccgaatcggatctgcgttaatttccgatacatgtttaccgacatcaccactcactgtcacttcgggcgcgatctcggttggttttgccatgtcacttgcccgatcaacatagcggaaaataactttgcctgtcgtcgccggtaaatgtatggtcgtctgattcgagaataaggttcccacactggctttgttgagaatcgtttctgcggtatcctttcgatcaattttggctttaaaacgaactctgaaaccttggccattcgggatcgtataaggaaaggcaatggtgccattcgtcttgaaactcgtgtcgtcaattgtcacaaactcgttgttcgtgtcagcatctgcaatttgtaaagaaccatctgtataagtggtattcggattgatacgtgacaccatcgccattttggccgttcgtctccgtcttaaactcagtctcgccggctgtgtcattgcgaaccgccttttgaagaacgaaatcttccggcggctgacgcaattgatactggtaggtcacggtgtaggacgttgtcgcagaaaattggcctgaatctttgccatcaggcgtatcagctgtgtacttgctagcatattgataccaattgttttgatattgaatccattctggtcgtctagacgatgcgtcccaactgttacccggatcaccggggatcgtgactggatcagcaatttgttggccagcagagtcggtaaacttaacagtgactggttttgcattctgaggtgtcttaatgagtgcaaccgcctgaaaagtaggattagcgccgctagcaccggtgtatccgtaatagactttgtctgatttaaagtagtctagaacatttttaatgtgaaaagtgcttccttgcgtcgggtcatcgtcaaggtaatattgcaaatcgccgcctaagatgcgtaccccattttgatacgtcacagacggtgtccacttaacaacaaagtgacgaaacttgccatccgaaagcggtttatttaactgaatatattgaagatgtccaacatcttctgattttttggtggttagcggtgtctcacccggacgaacaacgccaagatggccgaccccaaacgtatttggatagttcacatcaaatcgatcatctgcgacgccggatccgttccaccagttgtccatttcaactgcaagtgcgttgcggatatattgcttgatcatgttgtttttgccatcggtcgaccacggataggcgccaagtccgccacctggggagccataagcacctatcgtcaacggatcgttttgcagaacaaaggccatcccatcagcatctactccaggatgcgagccaaagtaatgataagtgtcatatgtaaatgcactattcaggtcaatctttgacttagaccacataccgccaatctgccaactcttcgtctcgcgactacctgtgacaataagtgcctgcggataagccttgctaaaagcggagacgttagggaagttttttgggtccgcttgactcttagtaaagtaatcactggcattcaacgttgaggccggtggtgctaccggaaacccatctgcggcaccatatgttttctgaatagggaaaaggcttagcgacaaaactgaaataataagtatcatcaacaactttgaaaagcttttcacctgagtacccctccctaattagtcctcttaattatttaatgcccaatttaataacgttctttattttatgttaacaatagaggtctcaaaaaacaacaaatatttttatatatataatatctaacgatacgaatatagcgctttagcacttcatagttaaggtgtcaagtctcaaaaaccagatgattatttattaaaatatgataatctttctcttcaaaggttaacagttcgttatgtaatgcttttcataaaaggcattaaaacctcattattaacgaaaatagatcgatcggtcatttttttaccgcaatctgacacaccttttaactatacttaacgagatttttcctgctgccatgccagcatttgaatttagccatgacatgagaagacgaaaaaagtccttctcagcatctctgctaagaaggactttttcaaatcattcaaatctaagcttgcggaccctgctgatcatcgttgtttgaagatgaattgtcagtcgaagtatcgtctggcttttcaacctcatcagaatcagtatcgtcgtcactggcttgctgatcaccagattgtggtgaatcagttttaccactggcttcttcatctgcttgcttttctttatctttgtgttcaagggctgctttggattgctcgaaagtagcggccttttcacttggaaattcatcttggtcacgagcaggcattttgccatcgttgaacaagctgaggatttccttttcattcaaggtttcgtatttaagcagtgcttccgcaatcaacttatgctgttcacggtgggcctcaatgatttcgtgagcctgtttatgggcatcgtcgataatgcgacgaatttcatcatcaatggctgtagccgtcgtttcagaataaggtggtgtctgaccatattgtgcacccaggaacggttggccttcagtttcaagctgaaccgtgccgagacgatcggacatcccatactgcgtcaccatactgcgggcaatttgagttgcctgttcaaagtcattggatgccccagtagactcaacaccaaagataatttcctcagctgttcgtccacctaagagtccaacgatttgttctgtcaattccttcttggtaagtaggaattgatcatcctttggcagcatgatcgcataaccgccagcgcgtccacgaggaatgatcgtgacttttcgaactgtccgcgaatcgctcaggaccaaaccaacaatggcatgtccggcttcgtggaacgccaccatattccgttctttcggattgatgacgcggtcgcgcttcgctgggccagcaatgacccgatcttcggcttcgtccacgtctgaggcatcaattgccttcttacttcgtcgggccgcgactaaggcagcttcattcagtaagttttccaaatcagccccgacaaaaccaggcgtctgacgagcgacttccttaagatcaacacttggtgcaagcggcttgtttttcgcatgcactttcaagatggcttcacgacccttaacatccgggcggccaaccagaatcttccggtcaaaacgacctggacgcagcaaagcaggatcaagcacatcagaacggttagtagcggcgatgacgataaccccttcgttaccggtaaacccgtccatttcaaccagtaactggttcaaagtctgctcacgttcatcgtggccgccgcccataccggcaccacgctggcggccgacagcatcaatttcatcaatgaagatgatggaaggagcagcctttttagcctgatcaaacagatcacgcacacgagaagccccgacaccaacgaacatttcaacgaaatctgaacctgaaattgagaagaacggcacaccagcttcaccagcaaccgccttggcaagcaaggttttaccagtaccaggagggccttccaacagcaccccggctggaattcgagcacctaatgccgagaatttccgcggatccttcaggaattcgaccacttcaaccagttcctgtttctcttcttcagcaccagccacatcggagaagcgtactttgttggcatttttatctgcctgcttcgcccgtgatttgccaaagctcatcacccgaccggaaccaccgccttggccagcctgattcatcatcatgtagaagaagaccatcatgatcacaatcggcacaaccgtaatcagcaagctaaaccagacgccggattgtgattcttcctgcgtgtcggttttaacattgttagcgctggttgccttttggatctggctcaaagtcgcatcgttcgtcggaatatatgtcgagaacttcgtgactttggtgctctgactaccaaacagactcagcgagttatttgaactagaagacttctgtgccttcttgtattccccactgaccttatagactccgccagatggctggagtgaataactcttgacgttgtcttttttcaactccgacaagaacgtgctggtttcaatctcttgggacgatgttgtcccattatcgcgcatataatacgcaaaaccggtgaccaatagcacaaaaataatgatatacgttaatgtgctactgaacaggccgttttgttttttcttcatttagaacctccggcaacattcgattagtaccttatatactaccacaaacacaacattcagatcaggattttgctgcgtagatttccggttttaatacaccgatataaggcaggtttcgataacgttcagcataatctaagccataaccgaccacaaattcgttaggaacagttgtcccaacgtaatcggcgtgcacatcaacgacgcgaccttctggcttatccatcaacgcacaaatacgaaccgacttcgcatgacgcgttttgaaaatgtcggtcagatattttaaagtccggccggtatcaacaatatcttctacgattaagatgtcccgatccttcacgctggcgtcaaggtccttgataatcttgacttcaccgctagactcggtcgcatccccgtagctggaaacgtccataaagtcgagttccatgtaatcatcgatctcacgaacaagatctgtcataaacatgatggcaccttttaaaatgcacaccactaaggggtttttccctgcataatcgtgcttgagctcagcgccaagtcgtgccgtgatggcatggatgtcgtcttgagaatacaacaccttcaaaatatcggaactcatgatttatcctcacttttgtcaacatctggtgattgcaccagtacaacatggagtatatcagtttgatctatggccgacaatcgttctaaaggctgaccttcaacccaaaacacttgatgaccccgagctaaaaccaataattgatcgcgctgataggctggaatttttgtgttaatcaaaaaacgccgcagtttctgaatcacgccattgggtaattgcacaacatcgccagcttgccttgtgcgcaaagtaattggcagtttcactctgaccggcgtgcctttgtcagcagcaacgcttgtctgcaggctgaaaatgccacgactggtacgatgttgctgatcaagcttagtgaatgtgaccggtttaactggcgcctgccgcgttaagcaaacaatttgttcactctggacagcaattgaaatcccgccgcccagatcaaaccgccgctcttttgtcccgcttagactcgctagaactggcgaaagtagctggcgatcaacgttggggtgccattgctgcagtattttttttaatagcagacgctgaacagcttccggctgcgatgatgcggcacgccaattaaccgttgcgtcatcaacctgcaggcgttgaagccactcagccagttgtgcttcagccaacgctaataggccagtctgctccatcgtgaatgtttgaatatgcgccagcaattgcgtgttttgttttttgaatgcaggaatgacctgatgacgcaactgatttcttgcgtaatgcggatcagcattgctggaatcttcgcaaaacctaacgttgtgctgatcagcataggagcgaatcatcgccttgctgtagggcaataatggccgcactaaccgacgtccatgccaagctcgatcagcgcgaataccgattaacgcggccggatcgccagagcgcgccagccgaaacaaaattgtttcaagttgatcatccgcatgatgagctgtcatgacaacctcagcatgctgctcagcggcagtcgcggctaagaaggcatagcgtgcttgccgagcggccgcttcactggttggctgcccatcagatcgccgccattgtccagtcaccactggcacctgcaattgttgggcagcggcgacaacaaaggcttgttcctgctgactctctggtcgcaggcgatgatcgaaggttgccaccaccacatctaagtcagctgctttgacagccaggttcaataacaccatcgaatccacgccgccagaaaccgccacgagcacacgagtatgcggtgcaaagccaaatcgttgaaaaagtttcgggctcatgggcatcctccacgcaatcctgcagaaaccaagaaaatgggcctagaacaaaatgtgctttgttccagacccgatttttaactgcggcgaccaccacggccgccgcgtttaccctcggtattgcggcgaagaacgcttaatcgatcttcgctttccttcaaatatcctgacatcatcgcatcaaaatcatctttggatggttgtgctttgtgtccaaaatgattgccgccgccactacgcgcaccgccttgatagcgattgccgcttggccgagcagatggtgtatgatgactctcccgatgactattttcgtgttcactttgctgcggtttatcgaccgctttccggatagacaggccaatcttaccatcttggatcgaaagtactttcaccgtcaccggttcgccaacatgcagcacatcatgaatatctttgacataagcatcagagacctcgctgatatgtaccaatccggtcttgccatcgcctaattcgacaaaagcaccgaattttgtgatcccggtgaccttaccagtcactttcgtaccaacttcaactgccataaaaaaagaagtcctcctagttaaatgtacctattagtatagcacggcagaaaaccgacgcaagagcgcaagccagcccggttagaaaccggagtgtaagtggcttgggtcgtgatggccgagttttggccattgcaaccaaagtccttacacgcaggtttctgggctggcgagcgcgtttaagcaagagcgcgaacagacccggttagaaaccggaacataagtggcctcaagcctaaatggttgggctttagccatttaggcttgaggtccttatgtgcaggttcctgggtctgtgagcgcgttttagatacaacagcgtccagagcctagcctttctatttagctgtccaaatcactgattcacattcaaatccggaaccttgttgaccttatcaggcaagttaaaaataatctctccttgcttcgaatagagatatttttcgcgaatcagcttagccgtgtagtcatcattgtgcagttggtcgacctgaaccttgagggctgacttgttggcttttaattttgtcaaactgcccttcgctttttggacggcgtggtttgtctctcctaacgccatttgcgttcgaactaaactaagcccgccgaaccccaaaatggcgacaatcacgatcaacagattccgaatccgcttcatatgtacggcgtgcgcccgtggattgggcgtacgtttgtgcttttgttcgtgctcacgcgtatacgcattattcaattgactgatattgttctttgccatttgaccgcaccttcgtttttcaccagccatttacttacatccgtaaatcaataaatcaagtataacaaatcccgagggctgcgagccaataaatacgtattaaaatgtttctttataatcctctttcaaaaccgtgtacatccccgctgcgtcatttttcttggtggtttcaaccaaatcatccgctcggacagtaagcgtcttgttgccaaagttaatcactaacgtatcccccacacgaacatcagagcttgacttagctggtttatcattgatcataattcgccctttatcggcaatttctttggcaactgtgcgccgcttaataattcgagagacttttaaaaacttatctaatcgcataacttaattacctcgctttatccgttgtaagaacttcatatatagtttaccgcctggcaaatcgagcatttctcgcagcgttagcattttaagccaagtccctgcggccaagaaaatgatgaccccaagtaataccccaacgactgtcacacccgctgccaccatccgggagcttaacggaatccaaccgacagcggcgtagactgccgcggccatgataccggtcacgatgattaacttagggacgaacagacggatggcactagcacctttgatcgtctcaggaactgcataataaatcaagcaaaggatcaagcccagcgagagaatcgttgcaccacttgccccggcagtaccgaacttcacgacaagcggctggttgatgacggctttaagcaatatgcctagcaatagcgcgacgctaatgccggcatactgatcaagactttgcaaaatagcattataggcattgatcatggcgacaacgacaatagcaaccgcatatagttgcagcgcaaatgtcccggctgtgtctccaaacagcagcaaatcaatagccggcatcaaaacaatcaagccagctgtcgccgccaatgcgaacgctaaattaaaatgcaccaattcggcaccgctgcgaataaactgacggcgctggcgggcttggcgcgcctgagtcagactcggtaaaagcgttgtcgacaaggatgccgctactacaaggcccaattgcactaaaggctgtgcccggtcataaacccctttaagacttttcgcagtcaccatggcgatacctgaagctgtgagcccttttgtaaccgtaaagctatcaatcagctgcaacaaaatcaacaaagctgcgtaaagtgtgatcgccccgccttcacggacaaaccggctaatgagacgtacataagcctgcatccccggaaaacgaaagtgctgctgaccaaacacttgccgatatggccgccataacgtcaatgccgccgccgcgccgccgaagaatgcaccggtcattgccacagcacccatctgataaacgctccaatgatattgcaaaaaccaccaagctgctagcagaatcacagcaacacgcacgacttgctcaacaacctgactagtggctgttttagccatatcaaaagtgccttgaaaataaccgcggcctgtggccagcaacggcatcgtcaagaacatgaaagccaccgtttgaatcaacggcagcaattccggatctgccatggcttgcgcgatcacgccaccaaagatttgcaggcctaaaaacaatgcccacgagatccatgttaaaatcacgcggctttggtgcgcgactgttagcttggcctcatcgctatccgcttcagcaactagtttagaaatataaaccgggaacccggacaaagcgaatgtcatgcctaatccgtaaatcgggtaaatctgttgataggcatagaagccggtgtcacctaccatgttttggaacggtacccgataaacggcactgagtattttggcgattagtgagctcaggctcaaaatccacgcgccgcgcatcaagtgcttcatttcttggttgtgcatgggagccctcctatcactatatccactgacaccgaagtctgcttgagctgattgatcattggcatgtcatcacagccaagttgggtcaaaaacaatgaatgcccctacttttcacagcaactatgccgatttcttttccggttgcggattgacaacagtcagtaatccctgcaaaaaaccggtcaattgatcaagccaagtcgcagtcttcatatcttttggcaatgctaacgtaactgtcagcttgccatccgtgatcgcgatctgcgctttcaatgttgtcgcacttaacgctttgaaaatcggctcgccttgtgctttagtggttgcttgcggtgacaacacaaccgtcaatttttgccccgccttcgttacgtgattgacccaagccaagtcagcaaaccgtttgagatgcgcaatcgccaataaattggtcaccggttgcggatagtcgccaaaacgatcaatcagatcttcgctgatctcagtttcggcttcatcactgtctgcttctcgaatgcgtttatacaactcgatcttctgacgggaatcggccacataatcagttggcaggtatgcttccagccccagatcaatttcagcatccgttttctcagccgatttaataccgcgccgtttattaacagcttcttgcagcatctgggtgtaaagatcatagcccactgaatcgatgaagccatgttgctgcttgccaagtaggttgccagctccgcgaatcgatagatcacgcatcgcaattttgaagccgctacccaattcagtaaagtctttaatcgcctgaagccgcttttcagcaacttcattgagcaccttcatcggctgatacataaagtacgcataagcgactcgacttgaccgcccaattcggccgcgcaattgataaagttgtgacaggccgtaatgatcggcattctcgatgattaaagtattggcattgggcatgtccacgccagtttcaataatggttgtggtcaccagcacatcgtaagcaccgtgcaaaaagtcataaatgacgttctccaactgcgtctcagtcatctgaccatgcgcatatccgacacttgcatctggcaccagttcctccagttgactcacggtacgttccatatcttccacccggttatgcaggtaaaagacttgaccgccgcgttccatttcccgttcaatggcttcgcgaatcacgcctggattttgctccatgacaaaggtttgaatcggatagcgattcgttggcggcgtttcaatgacactcaaatcacgcacacctagcatggacatgttcaacgttcttggaatcggagtcgccgtcagcgtgagcacatcgacattactcttgagttgtttgatccgttccttatgcttaacgccaaagcgctgttcctcatcaatgaccagcaatcccaaatcccgaaaagcgacatctttagacaacagccgatgggtgccaacgacaatatcaatggtgccgttcttaagccccttaatcgtttccttgttctgatgcgctgtctggaatcgcgacaacaacccgactttgattggaaagtccgcaaaccgttctttcatcgtgtcaaagtgttgctgggctaaaatcgttgtcggcaccaaaatggctgcctgtttgccataatcgattgccttgaaagctgcacgcaacgcaacttcggttttgccaaacccaacatcgccaaccaataagcgatccattggcttcggcttttccatatcatgcttaatttctttggctgaccgcaactggtccggtgtctcaggataaggaaactccgcttcgaacttgtgctgcaggtcatcatccggcccaaatgcaaaccctttttccgcttcacgcttggcatataaatcaattaattcgtcagcaatatcttcaattcgggcagctactttgcgtttggttttctgccactcagcaccaccaagtttattgacgcttggcgttttgccatctgcggaaacgtatttttggactagattcagttggtcaactggaataaacagcttatcgttgttgcggtaaacaatcgtaatgtaatcacgatgcacaccgtcaacttctaatgtctccatcccggtgtattgaccgatcccgtgattaacatgcaccacgtagtcaccaggcttgagttcgttatagcttcgcaatcgctctgtattcgccagtgtttggtgccgtgcgtgacgacgctggcgagcattgaataactcgtgctcggtcacaacgactaatttcaagtcgggcagctcgaaaccatttttcagactgccttctgtcaattgcacctggcttggcaacagcttagtcggggctgtcatgacattgctaatctcaaaatctgacaacgtttcgctcagcttttccagccgatttttatctgtgatcaagaacaccacggtttgctgctgctttacccagcgatcggtttctgttttgagtaacggcatctgactgaaaaattgctgcacgttacggctgggaatattggtcaaactgtcaagtcgcaactgccccatgcctttttgaaaaaggctaaggtaaagccgcgggcgcttatcttgctgtgcaagttcctgaatcgtcaggttcggcgtgttaggtagcagacggccttcttcttgcaactgtgagtaccattctgccgtatcctgcaccaaggttgtatcgctatctagcaaacgactgtaatcatcgaatgctaccagtgcatctggttgcaaatagtcactgatgcgttgctgctctgggtatagttcggccgcatataaagctagattttcaggacgctcgtgtgccgatagctgctggccagtcgtcaataaaccatctgtaacggcctgcttagcggcggcatttttcacttttgccttgtaggcattagcttgcttggtaatgcgctcgccagcagcggccaaaacctgatcagtcgccaccatatcggttgccggcgcaatcgtgatctgctgaagtttttgcagactacgttgggtggcaatgtcaaagctgcggatggaatcgatttcagtatcgaacaattcaattcgaatcggatcgtcttgattcaacggatagacgtcaatgatgccgccgcgaatggcaaactgtcccggcgcgctgactaacgaatcacgtcgatagcccatggcgaccagctgtttggcaacggtttgcggatcaagctcggaagtcatatcaatggccaattcactagctgcccaatcggctggtgacggcaaaagccgcttataaccggccagactggttacgatgattccaggtttgccgctttgaataaacgtcaaagcattaatacgatcgttacgcgtctctggcgaactaaccgcgacttcagctgccaacacatcctcaactggaaaatcgtaaaccactgcatctccgagcaaactgcttaaatcagcagctaattcatcggcatgaaagcgattgttttcaacaattagaatctgctgcggtcgctgttgcaatagcgcgccaaaaaagaccgtcttggctgagcccgacagtcctgtcaccaaatggcgacccgttttcagcttcggccataatgccgacaatgctggatctgcctgcaccatgtcgatcaaattcatcgcgtcacctgcttctttcttctactaatgtacacatgtgcttcaccttttcgccatgaagtcacctatcttttaattaaacttattcatcagctgatcaaacggcatcccatttaaccaatcttccaaggcatcatcagccttctcaatcgcatcatcgattaacggctggtcagttttggaaaacggcgttagtacccaatcaacgacccgttgccgctgcggatgctgaataccgatttttagtcgacaaaactcatcgctgccagtggcactgataatatccttgatgccgttatggccgcctgctgagccgcgtttgcgtaagcgcaatttgcctaaggttaaatccatatcgtcttgcacgacaaaaatttcatctaattgtatctgataaaacatcatcagctcgcggacggcgcgacctgaagcattcataaatgtctgtggtttaacaaggaagatcttttcgccatttagacgggttgtcgcggtagctgcatcaaactccagcttgtcaatcgtcaggttcagtcgtttggccaagccatcaacgaccataaaccccatattgtgtttggatcctgcatatttctggccgggatttcctaggccaacaatcattttcattggaacttttatcctccttggggaaaacgcgtttatagttgtaaggacttttttgtgagtgtttctatattctggccggacgagctaactcgcttatcttctggtagcggccggtcacgttttgctcggaaacgcgctcacaggcccagaagcctccacatagggaccggggatctgtatgactgcttcgataagcatcgtgccttttgtggtagtggccggtcacgcttcgctcggaaacgcgctcgcaggcccagaaacctccacataaggacctcaagcttaaatggctaaagcccagccatttaagcttgaggtcacttatgctccggtttctaaccgggcctgttcgcgctctaacgcgaatagacggattttgccttttccgtccaaagcagtataccatactgacgccttgcgtctgtgcgagttgaccgtggaaactgttgaatttcccacattcgtgaaaacagatgctggaaacgcttacgttattggaagcttgcttgaaacaggattcacaagtcttgctgtagtaaggctcgacgccattttttgacaatggcaaaatcatgaaaaagtctatcaaatttgtttcagggaattgataatgtgttatactcaacgtgaaatgcagttttcatgcacataagaaaggatgatatcaccgtggcaagtattacggataaggatcaccaaaaagttattctcgttggtgacggcgccgttggttcaagttatgcctacgcaatggttttgcaaggtatcgctcaggaaatcggaatcgttgacattttcaaggacaagacaaagggtgacgcgattgacttgagcaacgcgctcccattcacaagtcctaagaagatttattcagctgaatacagcgatgctaaggatgctgatctggttgttatcacagctggcgctcctcagaagcctggcgaaactcgtttggacttggttaacaagaacttgaagatcttgaagtccattgttgacccaatcgttgattccggctttaacggtattttcttagttgctgccaacccagttgacattttgacctatgcaacttggaaactttctggcttcccgaagaaccgggttgttggttccggtacttcactggacaccgcccgcttccgtcagtccattgctgaaatggttaatgttgacgctcgttcggtccacgcttacatcatgggcgaacatggtgacactgaattccctgtatggtcccacgctaacattggtggcgttaccatcgctgaatgggttaaggctcatccagaaatcaaggaagacaagcttgttaagatgtttgaagacgttcgtgacgccgcttatgaaatcatcaaactcaagggtgcgaccttctatggtatcgcaactgcccttgcccggatttcaaaggcaatccttaacgacgaaaatgcggttctgccactttccgtttacatggatggtcaatatggcttgaacgacatctacatcggcaccccagctgtgatcaaccgtaatggtatccagaacatcctggaaatcccattgaccgatcacgaagaagaatccatgcagaaatctgcttctcaattgaagaaggttctgaccgatgctttcgctaagaatgacatcgaaactcgtcagtaatcatcacgatcactgataagtaagcaaccagcccagtcgctggttgctttttttgtgagcgcgagcaggagcgtctagaaaccggagcataagcgaccatggccgtgatggtcgatttttgaccattgcagccatggtccttatgcggaggtttctgcgactgcgagcgcgttatggtgagcgcgagcaggagcgcctagcaaaccgcaaatatctaaatgttttttaataattctgtaacaccacggtaacacttgatattgtcactcatgccgcgtttgaaacaggtgatgttgcttttaattcgaccttcaataccttataatggcgaagtacaatgtcatcttatttgaggaagtgcttgccacgaaacaagaacaaacgaagaacaggaggcagcgatcagtgaagaaaaacaagcgatggctcctcgttgttggcgtcctcgtcgtactcatgggcggattttacatcattcaaagtatgcattatcgcgaccattttctgccaaacacagaaattctcggtgtcgatgtctccggccagaccgtcaacgcggctaacaagaaattgaccgaccaattcgatcaacgtcagtacacatttgttgaaaagaataaaaagattttgaaagttaaaggtgatgctttaggacttagccaagattttaaaaaaggcttaacacaaatccttaacaagcaaaatccttggcaatggacgacatcagtctttgctggtcaaaaaaccaatgctcaggaagaccctactattaacactgctgctctaaagcaattcgcaacttcgacggctgacaagttaaatcaaaatcgtcaggaaccggtcaatgcgaagcttgtgacaagcggtgatcagttcaagattcaaaaggaagttaatggtgatcaaattgatgccgacaagctggcgacaactgtcacaagcgcacttgataaccatcgtcaagtgattgaactaacagatgcttataaaaagccaacggttaaagcatctgatcgcgacttgcagacaactgaacgtgatatgaacaaacttgcaagcactaaagtcagcttgcagattcaaagcactaccgtcacggttccgcaagcaactgttttgagttgggtcactaatgataatggtaaggcaacggtttcttcccaagccattacaaattatgtcacggccttgtcgcaacaatacagcaccattcacaagactcgtcaatttaattcccaacaacaaggtaccgtttccgttcccgctggcacttatggttggagcatcaacattagcgccacctctgctatgattcttgctagcgtaaaagctggccaagacttgaataaagaagtcaaccacagcggatctggttatacaaccactggcgacatcggcaatacctacgtggaagtctccaaagaaaaacaacacgaatggtatattaaggatggcaaggtcgtcatggattctgacatcgtgactggtaaaccaggccaagatacgccgtctggtgtgttctacgtttggtctaagcaacgtaacgctaccttacgcgggaagaacgacgatggcagttcttatgccagtccggtttcttactggatgccgattgattacaccggtgttggtcttcatgacagtccatggcaaccaaaatacggtggtgattggtacaaagaacatggctctcatgggtgtgtcaacaatccgccagacttcatggcgaagttatatgcagctgttgatgaaggcacacctgtgatcgtgtattaaaaatagattcgctcaacccataactactctttttagcgtcacaaaaagacttgatccccgatatcaaaggatcaagtcttttttgtttattctaaattgtaaacattagctgatcggacgcgaccttacgccacttagcgttaatgtttctttgagtcgtttatcttcattgcctccggaaacggaattcaaaagatctttatcaacaaaacgctggaacaattaggcattcgtaaggctaattggtacaacttcggtaatatcagtcatgcaacaaaaaaaacgaacccattatttaatgacatgtcaggaacggtcactgcacttttaaaaacaatcgtttccgaatagcattgtgcaacagatataacattacctctgaaagtgatcttcagcatgaacagtccagaaaaacgttacaccgccagtgatctatggtatcataaagcaagattagaatattttaataaagtgatacctgtttgatggaggaaaacgaatgttaattaagtcgttagtattaaaaaaggagttcctgaccactgtcaaggaaacggtcacccttgaagacgcgctgaagatccttgaagactccggctttcgttgtgtgccgattctggatgaaagcggcacgatcttccgtggcaacatctacaagatgcacatttatcggcacaagtctcaaggcggtgacatgagtttgccagtgacctatttgctgaagaatgccaccaagacgattccagtcaatgcgccattctttaaagtcttcttcaacattaaggatttaccgtatattgctgtgcttgatgaaaatgccaacttttacggtatcttgactcacgctaaactgcttggcatgctgtcagaagcttggaatgttgatgttggttcctacgtgctgacagttatgtcgaccggcgagcgtggcgatctggccaaaatgagcaaaattttggccaagtatgtgtccatttccgggtgtatcaccttggatgccaaacgcgacgagttcgtacgccgcaccctctttacattgccggccggaactgatgaaaacacattgaacgaaatcgtttcccggcttgagaaaaaaagcttccgcgttgttgaaatcgatgacttgcaatcaggccaaccaatccgcatcgatgaagatctctaatctccatgtaacgctcacataaacaaaagaaggtcgatcgtttaataaacgaatcgggctttttttgtaagcacgtgcagaagcgcttgcaagcctgcaagtgccctatggtggtgcgtgtgttggtgcatgatcgtgaacatgaagaacctgccttaagaaccttgcgctttgcgcgaaaggtctttgctgtccacatcatcaaaaatccactataatatgggataatgcattgttagttgttatcgcgctgcatactgaacgggaggaataacgtgaaacgtatcactcgttttttcgatcagatcgcggccagcatccacttttttaagacgcatcgtctcaagcgcaattatcgacgagcacttttattcttcgcgatattgttgccagtttgtgttgtcgcaattatagcaggtcaacggttacatcagccgacaccgtcaagttcgaaagccgctatcgctctatcaaccacaaaaaagaaacaacaacgtcacaaggccaccagtcataaaaccaaggtacatacagccccgaagaacattgactggacagcaccttccgagaaacaggcttatcccgacctcacccagcatccgaacattactttagatgtcaatctaaaaaagcaacgggtttttatcaaggaaggcaacaaaacgctatacacgatgtatgcgtctaccggtattgatgactcaaccccacgaggtgattttgcgattcaagacgaacggggttatgaattcttcaatccaaacgaacaaatgggcgcccattattatacaagcttttatctgcatggaacttatctttttcataccgtcccgacagatgtcggcggacaatacatcaaaaacgaggcggctaagcttggcaaagagcctggctctcatggctgcgttcggttgagtattgcggatgctaagtggatattcgagcatgtgccaacagggacgccagttaaaattcattagtttagtgcctcaaaaaccagagaaacctgttaatcaatcgactgactaacggattcctctggtttttgtgtaagtagtggctgttgaactaggccgccatatcttcgacccttgtagtaaatttatagcgaatttgataggcctcaccctcgaatttagccaaaattaaaattggtatagcaaatacccttaacagggtcagcacattgctcaagacgatggccgcgtcaatcttgacggccagtgattcagctgtccgagtgttcaccaagtcaagccccagcgtgcccttcataaaagcaaaccggcgttcaatggtacctcttcgattctcggcatcagtatcctcacgccgtttcgctgcatcaacgtgttttggatgccggccaagcttcggaccgcagattcggatacccaaatccttacacagctttaggttctcccgattacggtacagcgtatcggccagtacttcatccggataatgtccatgaaggtcgtaatagtggtctaaagtttccgcgaagtcttggccctcagagaatgcggtgaaatcaaaacgttcaatgtcgactacgccttcacttaacgaacagtcaatcttcgccccaaattcaactttagcattggccttaccacgttgaattgggcgaatgtacggctgttggagactaacaattcggtcttcaacgtggtgagtcttgtgggtatacatgtaccattgctggtcaaatagaattcgaatcacgcctaagcgaatcgcttgttcatctggtagagtcgcaccctgatcgatgaattcgttgatgtaccgcaaatcacggcgcacatattgaagttgggccttgacctgtttatgaaagccaccacgctgttgctttggatgtcgtgaaaatgaggtccaacaatgcttcgcctcgcgtttgtacatgcgtgggtttggcacaccaagttggtgtgccatatcgatcgccatcgcctcaagattcagccttgcttggttgaggaggacggtgtcttgaggatacttgattttgactggcactgcggttgcgtccgtgatgacggtgtccactttgaatgggaccaacgcttcgatcttggcgcgtactgtatcattcatgatattcgtaatcagctcggagatatcggcaattcgtttgcgaaagtgtgccaggctggaataattgaacggctcaaccgctttgtattcggacaacccgatgaaatattgaagtgcgggtgtatcacgaattgccgcaaccaccccacgatcagttaaacccatccgttgttggatcaggattgccccatagagtaaacgaaatggttttgccgcacgtcccgcatttttggtgaactccaattggtatgcctcatcgagagctttccagggcatgacctccgccaactggatccactcattgttagagctaagtggggtacttaaaccggcaccaaaggattcaaatgacaattgaagcgggctgtgacgatagaccatacgataacctccgagtaggttcccaaaaaatgcaaggaaaatgcaggaaaacagctaattccaatggatttattataccgcaataatgcatatattagcttaactgcctgaattatagaatttttaagcagccactaagtacgtatcaatcgtcagaatggtgagcattacttttcgccaatccgccaactagttaaattttctcactggccaacgtttgcaatgatgcatcaattttctccgcgcacatcctgccttcatgaatcccccagataactagacttgggccgcgacggcaatcaccggccacatagatttgcgtgtcattggtcgtgaagttatcatttttggcagtgatgccaaattgatcaaaaagccattgttcagcgccagtaaagcccattgctaaaaccacaagatcggccttaattttcttttcggtgcctgccactggtttaaagtgatcaacctgactaatttctgcttctttgacttggccatctttgccgaagaaagccgtcaccgtcgaggcataggcggtaatgtcgccaaacaatgctttagcctctttttgcccgtagccggttttcaaaaccatcggccactcaggccattgattttgcggtgttcgttctgctggcaatgctggggtgatttctaactgggtgatatcagcgcatccctgacgaatcgcagtgccaatacagtcattaccagtatcaccaccgccaagaaccagaacatgttttcccttcaactgatcatttgcggctggcccatcttttaaaactgtttgggtggctgctttgagaaaatctgttgcttgcataatgcctgaaagttctctgcctggcaccttgagatctcgagcttcgcgcgcaccggtgcaaataacaacccggtcaaacgttttcttcagctcatcagccgtgatgtccttaccaacctccgtgtttgcaaccagttcaatccccactttagtcaacgtatcgatgcggcgctgaacgacatcttttggtaacttcatattaggaatgccatacatgagaaaaccgccaaagcgatcatcgcgctcaaataaagtgacggcatgcccgagctggttcaatcgccaagctgcagcaatacctgccggaccactgccgacgactgcaatttttttaccggtgcgatgcaggggcttaccagagtcaaccacccagccacgtttgaatgcttgctcgataataaatttttcgttgttacgaattgtaatgccagcgccgttgagtgcctgcacacaggaaacctcacaaggtgctgggcaaacgcgtccggtcatatccggcaacatatttgagcggctcaatcgttcaaacgcacgcttatcctgatcacgataaaccagatcgttccattcaggaatcagattatcgttggggcaaccactcacggctcgtccgccgccaaaaaagacgccatgatggcagaacggaataccacagttcatacagcgcgctgcttgcttacggcgttcagccatgtctaaatcaagttccatcacattaaaatctttgatacgctgcatgatcggccgcattggatcgtcttgtctagggtattttaaaaacccttttggatctgccattctgttccctcctcgtaaacgcgttcaccagcccagaaatctgcgtgtaaggacctcaagcacactggccaaagcccggccaatgctcttgaggccgcttatacgccggtttctaaccgggctggttcacgctctctatttcattgcttcatcaaaggctttttcaatcacttgttcttctgaaagtcccggtttggtgtaagcatcaatcaagtcgcgcattcggtgataatcgcggggatagacttttacaaacgtacctttttccttttcccagtgatccagaatcatctgggccgtttccgagtgagtatactggacatgctttttaagtagttcaatcagaatactgtcgtctccagcttcatccaaatgataaagatcaactaggtcttgactacaatgcttcgcaaaatcgtgtgtccagtcatagacatatgcaatgccaccggtcatccctgctgcaaaattacggccggttcggccaaggatgacggcgacgcctccggtcatgtattcgcacccgttattaccaacaccttcaacaacaacattggcgccagaattgcggacacagaaccgttcgccagcacggccattgaaataagcttcgccaccagttgcgccaaaacacgcaacattgccgacaatcggtgaatgggtgtacagttctcgagcttgtggcggtgcagcaacgattaagcgaccgcctgacaggcccttgccaacatagtcattggcttcaccgaccaacttaatggatagtccttgggtaatgaacgctccaaaactttgacccgccgtaccgtgatagttgaaagccagttgtcctggctttaatccgtcattaccaaaatgcgccgcaatccagccgcctaaacgcgtgccaaccgcgcggtccacattattgattggtaggtcaatggttgtggtattttgatttttgagactagtttcagcaaatcggtctaaatccggccagtcatactttggcttgaaaggattggcctttttacgttcaattggaatcgttttgcccagcatccgatcatagttaagggttttggctttcccaaaaggtacataccgcggcttcagatgctcgccgtgacccaccatttgatcgactgtgcgataacctaatgccgccatctgttcacgcaaatcttcggccaaaaattgcatcatgtgaatcacattttcgggtcgtcctgcatataacttgcgcagctctggattttgggtagcgataccgaccgggcatgtgttgaggttacatttgcgcatcataacacacccaataacaaccatggttaaggtaccaaaactgaattcctctgcgcctaacataatcgcaacagcaatgtcgcgccctgttaataacttgccgtcaacttccaatgtcgtgcgttggcgcaacttgttgagcgcaagcgtttgatgggcatctgctagccccatttcccatggcaacccacaatctcgggtggagtttcttggtgccgctccagtgccgccgtcatagccggagatcacgaccgtgttagcacccgctttcaccacaccggccgcaatcgtaccaaccccggttgaagaaactaattttacattgattttggcatacggattgacctgttttaaatcataaatcaattgcgcgagatcctcgatggaataaatatcatgatgcggtggcggcgagattagctgcacaccggcaatcgagccgcgaatgctagccacccaagggtaagctttccctgctggcaactgcccaccttcacccggtttggctccttgtgccattttaatttggatttcttcagcactcatcagatactctgtgttcacgccaaagcgcgccgttgacacctgcttgattttactgttgcggttcagaccatctgcaccgatatgaaatcgatttctgttttctccgccttccccggaattactacgtgcacccaacttgttcatggcaatggcaatggtttcatgcgcttcttcagagagtgccccaaaactcatcgcgccggatttgaaccgtttcacaatggaactcaccggctcaacttcgctcaacggcaccggtttacggccgttttgatcaatcgtccacatcgatcttaaggtcactggattttcctgttcttcggcatccagctctgccgtgtactgttgataggcctgatagtcgccgttcctgactgctttttggaattgataaatgctcttgggattgtacagatgctcttcaccatcggccttatattgaaaactcccgccagaaggcaaatcgtcaatcgcgtgattgctgaaggctcgctgatacttttggtaatactcgtcttcaagctggttaagattgatgccaccaatccgagttggcgttccggtgaagtattggtcaatcaaactatcagccaaaccaactgcttcaaacaattgcgccccttggtagccggcggttgtcgaaatccccatacggctcatgattttgatgatccctttggtcgccgcttggcagtaatctggcaattgcgcttcaaggccacgttcctttagcgtcaagaaagcaccatacggatgaatggcagcggcaccgtaaccgaccagacaagcaaaatgatgaatttcgcatgcctctgccgtgtcaacgacgatagacgcagcagtgcctttactttgccgtaccaaataattatgcaagcctgatacggccaacaaaaccggaatcgtcatctgattgtcagcaactggtcgatcactcaacactaaaatcgttgcaccgccatcaatcgcgttttccgcctgcgtgaaaagatccttgagcacgtgcgccaaacgatcgggcgtatccgtcaaatcataagccaacgacaatttagcgacttgtaacatcggcaaatccaagttgagaattttagcatattcttgatcgcttaaaatcgggctgtcaattttaagcttgtgacaattttcagcagtatcgcgcgtacaatcgccatcgcgacctaaaaagccaaaagtcccaatgactactttttcccgtaatggatcaattggcggattcgtcacttgggcaaacgactgcttaaaatacgtgaacaaagattgcgattttttactcaaaactgctaaaggcgaatcaaagcccatggcaatgaccggttcgccaccattttgcgccattggcaacaacgctgtttgaatgacttcgtgggtatagccgttacgcagccaaagttttttcaaactgtcgatcggcatactttcatctgatttagcgtcaggtaattccccaacgttaatcggttggcattgagccattgctgataaggatgcgcttcggcacaagcccgtttcaaatcacgagtcttcgaaatgcggccggtactggtgtcaactaataacatctcagcaggcgccaaaatgcctttctcgacaatatcgccggggtcgacatccaccacccctgattctgaggcaacaaccaactgattatttttcattaatgtgtagcgcgatgggcgcaacccattacgatccaaaaaggcaccaacttgaatgccgtctgtaaagcacaaggcagctgggccatcccaaggggccatgaaagtagcattgtattcgtcaaacgcccgttgttcatcagacatttcggtaccttcgccccatgcttccggcaccatcatcatcaacgcttgcggaatggatcggccatgccgatagagatattccatacagttctctaacttggcggaatcagagtcagtttcatcataaatttcaataccatgactggtcatccaattttcggcgccctttaacgtgttgatttccccgttatgcgctaaaaaccggaacggttgagcacgatcccaactcggaaacgtattcgtggaaaaacgggagtgaatcaagcaaatggcacttttcatttgcgggttatgtaaatccgggtaaaaaagacttacttggtaagcatgaagcatgcctttataaacgatggtgcggcttgagaaagaacagatatacatggcttgccgatcaaaggttttctctaactgccgtcgcaatgcataaagatgatcctcaaagtcctgccctgcctgtgtgtctgtcggccgttggaccacaacctgaacaaagcccggcatagcttgttgagccgcgggaccacagttttcgtaaacaaacggaacattgcgcgtccaaagaaccggaaagccggcttcatcgatttgactcacgaccgcctttaacatggcggccttttcttctgcatcatgcggcaaaaaaagctgagccactgcatagtcaccttgcgccggtaacgttaattcatagcggtgcatttcgtcacggaaaaaagcatccggcattgccattaagataccggcgccatcacctgtatcaggttcagcaccggtgccgccgcgatgattcatgcgttgtagcatggtcaacgctttttccacaatttcgtggctagcgtgaccatccacttgcgcaataaatcccataccacaggccgcatgctcaaattccggcaggtacattaattttttgtcatgtgctaagtgatccatgaaatccccaccttattagttaacatcaatgtcttgagcctaaagatattggtctcatagtattctaataatgacaagattacaatgcttttttctttgtctgccgtttcacatttggctccgaagtctatcaaagcttgcagaatccgccatctggtcacaatcaaaaacagtgcatcagactgatttaataggaaatcagactggtgcactgttagtcatggtcggttgcaagatctttttttattttttagttgtttaagataactgccatcattttctcacgatggcggcgtgaaagtggacgattttatcaagtccgtacatgatcggcgcagaaatcgtcatgataatgaactcggaaagcatcaacgaaacataggttggtaaaaacattgtggcgaaacttaaatgccccgtccacacaatctcaacggcaatcaaggccatcgtgatcgtcatgacagcgatatttaaggcaaaccgggcccagagctgacgcaatttcggcgccacccacccgaccaacagcaagccaagcaaactttgaccgccgccaaagaccacgtcaagccaaccaagcggtgagaagatagcattgaaaatcacgactcctgtcacaacacccacaatatatttacgatcaaacacgaccaagtgattcaaactttcagacaagcggaattgaatcgcgccactggccaaattaaggctcgcgggaccaattgatagcacaatatagatagcagcgaccaaagcattaagtacccaaccgcgtgtttttagatttgtcatgaaagtcctccattaaaagtcacattatttcgtcatagcgcgtttgccggagcagaaacctacgtaaaaagacagcgaatgcagtaacccaagccccgtcatcacgtttgaggccgcttgtctccagtttctaaccgctctggcgaacgttcaacaaaaaacgcgctgttaagcgcgttgctgttaattcttattatatgttttgggcttgggcaaactgaccagacccactgaaatcgccaacgcgcggtcgactgctgccattttggtgcttgacagagctgtcacgcgggcttgtagccgttgcttgtcaatcgtgcgaatttgctcaagtaaaatgaccgagttgcgttcaacgccatcttgcttggcccgtaacccgacatgcgtcggcatcttgggtttttgaatcttggaggtaatggctgccacaatcactgtgggactgtaatggttgccaacgttgttttgaataataagtactggccggttgccgccctgttcggagccgacaaccggagacagatcggcgaaaaaaacatcgccgcgttttacggacacatccatgcttttgcccccttatcgctcatcgaatatgggcgtatgcctcgctctcgcaggcagagaaagcatgactgatctctgtattgatctggcccattgctacatagccagaaatcaattggttgatttcgggagcctgtgacttcaaaaatgtcgccactgcctccgtaatcacggcctgagcgtcaatgtcattcaattcacaataggcatccaaccgcgccttaatggcatcatcaaacgttaccgctactgacgtttgctttttcatgacaacttcctccaacttcccaagttcatgttgttactttagcacaaaatgggcatacgagccaccatcaatcgaccggattcacgctctgtcgcttcaggcgcggcgttaaattgcaggcgatttcgtaatgaattgtcttgctatatttagcaacgtccaacaacgtaatctcctgatcgccactttgcccaaccaaaactacctttgtgccagctggatatgctttgggcaaacgaatcataaactgatccatgcagatacggccaacaatttcacaatactgaccatcaacaaggacatgaaagccctgtaggcgccgcagccagccgtctgcatagccaatcgggacagtcccgatgaattcatctcctttggcacgataggtcacaccgtacgaaataccgtcaccagcatgcacctgcttgcaataggtcaactcactttccaatgacaacgctggttccagtggaaacggtgtggttggaatcgcgtccccagacggatttaagccgtaaatagccaccccataccgaatcatattgccattgcaagccgcatgccacaagctggtagccgaattagaaacatgcacataacgcggccgacttggtaaaagattgaccagatgattgaacttgtcaacttgctgtttgaaataagtatcatcaggagcatctgccgttgcaaagtgagtgaagaccccctcaatgacaaattgcttgggatgcgcttcaacaaacgcaactgccgtcttgagtgcttgatcttcggtaaacccgatacgacccatgccggtatctaaggccagatgaatacgcaacggcggcagctctggctgtgcttctaacactggcaaagcctgttcaagccattcggtgctgctgacaggcaatgatattgtttgggcagcagcaatggccgcatactgactcggtacgatgcccaacaccaatactggttcattataatcggccttgcgcaaccccaatgcttcatccaagatcgccacacaaaaaccggttgcaccagctgctttagcaacccgcgccacccgcaacataccgtgaccataagcatcagccttgaccacagcgaaaagctgcgtctgcttttttaatcgtgcgacctcatgctggatattatgcaaaatggctgtttcatctattaataccgttgctggtcgaaagttaccgatcgtcacgttcaggaccttctttttctaaaattacctcggtgaagaccaaggtttcactgtgcgaaatggagacaaaagcctgaccggaaaaaggatgcttcgtcagaataggtttgcccaactcattattgagaatttcaacatcctgtaaggcgacttttcctaacccagtaccaaatgcctttgagtacgattctttggcagagaaacggccggaaagatattcaacggcgcggcggccatcgagttgttgataatttgctaattcagtcggcgtcaaaattttaaccgcgaagccgctgtttttttcctgtgccgcctgaattcgcgccaaatctgtgacgtccaccccaataccgtaaatcatgggttgcctccttaaccgcgttgacatcgccggaactaaccactgttcctgctcacgctttgtcataaagttattctagcatgcttttacagaaaacgggtgtttggttgaagcaaaaaaagaccccaggacgtttaacctgaggccttttgaacgctttaattaaaaatcattcgccattacggattttgaaactacgcttaacattcttgcgtttatcgctgaagttgcgttttttgtcgtaactgcgcttattatcacggttgccttgatagccgccttcgcgacgcttacccttgtaaccgcctttataaccaccacgattattgccgtgaccgtgattgctgcgaccgcgatgtggcagcggacgttctggcgtgattttaaccggaacggcactggcatcatccgggctgactgctttaagataagcggaaaccaactgtaacggggtatagttttccaacaaggattcagccatagcttcgtacttttcagtatcgttagcttcgacttgtgccttgatcgtttctaaaccgctggagatctggcccatcaatgcttcttctgctgttggtggtttcatcggcagcatccgcttcttggtcaagtcttcgatcgtgtgcaaatattcgatttcgtttggggtgacgaaggtgacggaaacacccttgtgacctgcacgaccggtccggccgatacgatgaacataggaatcaggatcttgcggaatgtcatagttgtaaacatgggtgacaccggaaatatccagaccacgagcggcgacatcagtagccactaggaagtccaattggccactcttgaactggcgcaaaacgctcatccgtttttgctgtgtcaagtcaccatgaatgccttctgcccgataaccacgcgcctttagaccacgggttagttcatcaacacgacgcttggtccgaccaaagatcaaagccaagtctgggtcttgaacatcgaacagacgagtcatgacatcgaacttttcgtagtcttttgcacggacataatactgttcaacggtatcagctgtgagttcctttgccttaatcttaacggtgaccggttcatgcatgaacttattggtcaaacgcatgatggaagcaggaatcgttgcagaaaacagcaaagtctgacgcgcggttggcatttgttcaacaatcttttcaatgtcatcgatgaagcccatgtcgagcatttcatctgcttcgtctaataccaagactttaagattttgcaacttcagggtgtgacggccaatatggtcaaggattcgacctggtgtccccaccacaatttgtgggtgttctgataattggcgaatttgccggcgaatgtcggcaccgccgtaaactgcctggaccttgattttcttatcttggcctaaacgataaagttcttcttgggtctgaatcgccaattcccgagttggggaaatgaccaatgcttggatactccggtcagccttatcgatgttttgcaggatcggcaagccaaacgctgccgttttcccggtaccggtctgtgcttgaccgatcacatctttgcctgccagaaccagtgggatcgtctccgcttgaatcggcgtcgcttcctcaaaacctgactgggcgattgcctttaagagatcatgatccaaacctagttctttaaacttcaaatgagttcctccttgagaattcctgcacgcgtttacccaagcgtgttttcaaaggaatccgcgggcatcacgtgcattttcagtaaatgacaaaaaaacatatccgaacaatagtatcatgctcactataaaaaaacaagtgccgagattcggccaagtcttgcataatcaccaaaagcttcagtcaacacatgcttatttaagcctaaactgacatttttaaaagaataaaaaccgtcaaaacatgctaaaagccgtttcattttcatggaacggcctttatgcttacaacgctagtattaagcacgaccaccagcgaccaaagctgacaaaacggtttccagatgcaatccgtgactcgctttcaacaaaaccatatcgtcatggttaacatcgttttgtaagtcgcgcgtcatctgttccttgtcatcaagcggataatagtgcaactgatcggctggatattttgctgccaatgcatcggcaagtgctttcatatcgctaccgtatagataaacaacctgcacttccttaggatcgagtgcctctgccagacctgcatgcaacgcgggactttgttcaccaagctccagcatgtcccctagcactgcaatgtgacggccagttgccgtaaattcgctaaaatcatgaatgacggctttcatcgcggtcgggttggcattataaacatcgcttagaatctgttcacccacatccccgatcaaccactgtgtccggttagccgtcacctgaaaatgagccaatgccttttgcatgatttcgggtttgacatggaatttgcggccaactaacagggctgctaacgcattgacaacattatattcacccataatcggaatcgagaacgtcagatcaggccaagcctcaactgtgaactcagtgtggttacgatgcccgctgattgaatgggcaaatatcgtattttcaggatgcaagccaaaagtttcgcgctcctgcgtgatcttcttcgcccgttcctgcaacaatggttcgtcaccattaaaaataaacgtaccatcatcctttaggccatcagtgatttccattttggcatcggcaattttatcccgggtcttgaaaaattcaatgtgtgcttccccgatcatcgtaatcacggccacatccggttcagctaaggttgacagtgcatgtaattgccctggccgatccatccccatctcaagaaccaagacttcggtattgggttccatgctgagaatagtcattggcacgccgatttcattattatagttatcaggggttttaacgacgtgatattgtgtggccaagattgcagcggtcatgtccttcgttgtcgttttgccattgctgccggtgatcgccaccactttgggattcactttcatcaacagataatattgtgccaattgttgcatcgctttcaacggatccggcaccaccagcgtaatcagcttggtggtgacaggtaaatgatctgctgcaacaaatgttgccactgcgccagccgtagcagccgccggaataaattcgtgaccatcacgttcaccgcgtaacggcacaaacagcatacccggcttcaatttgcgtgaatcaaaagccagtccggtcaccacatgcgacccgtctgcttcagagagcggttgagctttcacaactcgcgcaatctctgccaatgtcatcttcataattaattcgactccaattcttcaacttcatcctgtttaagaacaggttaaaacagtccattattggcgatgatcggcagatgcagcatcatcaatcatcatccactgattcttttgccgcatcaaaacaagcattcccaatcgccggacatctgtatccgtcaagataccatcaggaacgaaccgagctttcggtgccaaaagtggcacactgattttttcacgagaaaaccggacgttccggaaatcaaataccacgccatcctccaataatggtaaaaactgtgtatagacggcatgtgacacgcgagaaaagtgctgttgccgtaagcgtaaccagaatggttcctcattagcaattcgccgcatatacttgttaatggcgtttgctaagaaggtcgcaaataaagattcgttacgcagatacatattcaccataccgtttcgcaatggcaggtaaaccaactcgttttgcaatttgtagtaaaatggcgaacttaaatgcgttttggcatgtcctaagtatagcagttccgcaatctcgttaggcgtgagttcctgcaaaaatcgcgggcttgaataatctagccagcaacgcgtctgacccgctttactccgcaaaaagtcctgaacctgatccgcgccgtcgataatattgaaccaagtatgcggatctatctgttcctgctcatccacagggggcagcaataacagatgcttcggtacttttagatggtcgctcagcaaatcacttgctgaaatgccatatgtcaaaaacaaatgcgccaacggttcatggcgcacataaatcatcgcatttcgcacgtttaaaaccccttcaatactcccgacttaattatacgactttcacggcatcacatgcgttaagattaagagcgtgagccaacccgcttagaaaccggagcataagcggccttgaacgtgatggccgggccttggccattgcgttcaaggtccttatgtgcaggtttctgggttggcgaacgcgtttcaatcagagcgtaagtcaacccggtttctgcgctagctctcctcattctatctaagaaagggtgacctatgatgttacaaccatggcctaatcttatccctcgtcctgatttgccaacgattccaaaaacagcagccattccgcctgcttattttaagctcattcaaacaggtattttaccgatgaattggtggcttccgactaaggagccgacgagtgatgccattgacggcgtgggtatccacgcctttgcaactgttggcccagccatgacttcaagcgatttgccagcacattttttgccatttgccaaaaccgggcaccaatattttggcttcgatctccagcaggagccacgccagattcgctatattgataccgaagtcgaccagtggctgacagtggcgatggatttgccagctttcatgaagcaattgcagcctcatgaagcaaagttgccagaaatttcagtcgatccgcagatttttggacatatggccgtcatcgcgacagcggctgaatggccagcgctgtttgattacgcgcgcgaattcatggccggccaagcaattggcccatggctgcgatggctcgcccaatcaaaagaggaagctaagcggcaagtcgggatggaagaatttcattttctcacccgttaccagcccaacttcctcacacccaacgacacgctgacactgcagcatgtattcggctaatggttaaccgacttatggtcaggttggaatgcgaaggtgtccaaccaacgtagatcccgtttgattccaaaataaccaaacaaagcaagtcccaacgaaccaaagaagtccataaacaaatcacccatcgtgtccattaatgccgctcggccacgcagtagctcgccgccagtcgccatgtaccgctgcatattcaatcctaataatccatcaaaggtgaactcataaaattcccagagcacgccgatggtggtgccaaaagctagtgcaaacaaggccatcaacaacgggcttgttgatgtcaaccgtttttgcggggtcaatgccgcaaaaatagcaaatcctaaaccggcgagcatcgcggcactgaataaatgttcaaacttatcccaataaggcacactgtagcattgcaatcctgtccccagtaaaacgcttaaaagaataaagatctcgaataagtaaattaaaaccggtggaaatctaaaatgccaccaccgctccatcaatcgcggtaagctgacaatcaatatgccggacgcaacctgcgccaataacatcatctgaccatgaaataacgagcggccgctgatataaaggccaccaacaatcaataagtaaagcaggtcgccaccgacattcagccagtataaaaagttagatcgttttgtcattgtttttgccccttttctttaatgtaacatgacgcggcaagtcatttactacctctttgtaagcgcttggtgtagactcaaagataggaggtgttatctatgccgatcaaaacattacctgaagatcaactcgtcaccatgagtcaatttgtcgtgaaagatgtcgctaaagcttttgactttccctattatgtcaatgatctcacacatgacgcaaattttgacactgagcacacagcaaccaagttagaatttgagctcaccctgttgaatgatcctgatccagaacggaccatcagcttttacagtgatgccagcgctgacccgattatgggtggtgctgcatcagcacaggtcatcgttgagtcagggattaccttcgtttatttaaatgatggttacaaggattcctacctcattatcattcgtgatggtaaagtggtccaaaaccttaagcttgaacaacaaattctgtccggcccagaggtagaagatttgattgataatgtgatgccaaaagcgaaatgatttttgatgtcaaaaggcagccggattgcggctgcctttttggtcgcttgtgatgcgtcaaactgatgatcgtgcagataatgacaaagcgctgatagcctctgaaacgtgagaaaaggcacaacgcaactaaagagaccttttcttgctcaacaaaaaaaccaccacgagggtggaaaagtttgggggaacttttttgggagtgtaagttaatgtgtaagcttaaggctgaaatacatctgccttattgacctaagtatagcaattcactaactcttaggtggttccattttcaacaacaattctgttcattttataaatccacttatatattcataagttttaactacaaaaaaacagccctattggctgtttttggtttatttcttgtccaaaccatacttcttgttgaaacgatcaacccgaccatcggcctgagtgaatttctgcttaccggtgtagaagggatgggagtcggatgaaatttcaacccggactaatgggtattccttgccgtcttcccacttaacggtttcttttgaagttttggtggaacctgagataaatttgaaaccagttgctgaatccataaagacaactggatgataatctggatggatgccttgcttcataatgattactccttttgccctaaatcattgcctgatctagagatactcttacaacaactctaatagtctatcacggtcatggttcaaacgcaatctcaatcaatcaactcaacatctgcgccgaggccacgtaatttcatgacgacacgatcataaccacgcaagatattatcaactttggtaatcgttgtcgtgccttctgccattaaaccggcaatcattaagcaagcacctgcgcgaatttcttcagctgcaacttcagtgccttgcaaatgatcgcaatgatgcaaaataatgacgtcattttcaatagtaatatccgcgcccattcgcaacaactcaggaatatgccgaacgcgtttaggataaatggtatcaatgatcaagccctcgccatgagctttcagcattagcggggtgatgggttgctgcaaatcagttgcaaatcctggataaggcatggttttaatctgaaccattttcaaatcaccagacgggtaaacgaagatactgtcctcaccgacatccatgacgacacccatttcctctaatttagctaaaaaggcatctaaatgttcagaaataatatttttgactttcacaccttcgccgatcgcagctgccatcgccaaataagtccccgcttcaattcgatcagggatgatggtatgtgagttgtgtgcttcaagggttggcacgccgtcaatccgaatcacatcggtaccagcgccacgaaccttagcccccatattattcagatacgtggctaagtcgataatttctggttccttggcagcattttcgatcacggtccggcctcttgctgttaccgcagccaaaatgacattgatcgtagcaccaacggacaccatatccaaaaagatgcgtgcaccgtgcaagccttcagctggtgccttgatggccatcgcgccgtgttcattgctgacggaagcccccagtgcctcgaacccttttatgtgctgatcaatcggtcgtggtccaatatcatcaccgccgggcaagccgacaattgctttaccaaaccgccctaatagcgctcccatgaagtaataggaagcgcgcaaactttttattttgccatttggcagggggacatcgttaatttcagttggatcaatcgttaggacgttctcagtaaaatccgatttgacattcatgtcatccagaatcgccatcaaattatagacatcctgaatatgtggaactgaatcaagtgtgaccggggtgcgtgacaaaatcgccgccggaatcaaggcaacggtactgttcttcgcgccgccgatcacaacttcaccggataatttcttcccgccgtggatcagcattttttccattgagttaaatcctcacttaaaggtcgttcatttcaaataggctgaagctggcctgcatctatgcttcaaaataaactgcgatttctggtaggcgaggcacaacaaactcatcatgcactcaacatacaagtttaatgaattctatgggaaaaaacaaggactaaaagaacagagcgcgaactggtgcgattagaaaccggaatgtaagtggccttggtcgtgatggtcgctctttggtcattgctgtcaaggtccttacatgcagttttctgcgccagcgaacgcgtttaagaacctgagctgcccccaagtgcttcatctgccaaaaaagccgtcccaaagtaatgatacctcaggacggcctttataaatcaatgaaacctgctattaagctttaaaatcgcctgctgcctgaatgaaggctttgaataatccctccggcttgtttggccgcgattggaattctgggtgatattgtggggcaacgaagaacttgttcttcggatattcaataatttccatcaagcggttgtctgggctgacaccggaaaataccaatccgtggtcttccattgcctgacgatacttggtgttgaattcgtaacgatgacgatgacgcttttgaatttcatgggcattgtcataagccttcgctgcaacggaacctggcttcagaacacatggataaaggccaagtcgcaaggtaccgccaagatttttgacacccacttgatcacgcatcaggtcaatgatcgggtccttgatatcaggttgcgtctcagttgtaccagcatctttcaggcccagcacatcacgcgcaaattcgactgaggccatctgcatacctaagcaaatgccaaggaatggaatatcgttttcccgagcatagcgaatcgcggcaattttgccttccaaaccacggtcaccgaatccgcccggaacaagaatcccatcaaagccttgcaacaagctttcaacgttatcgtcattgacatcttcagcttggaacatttgcagatcaatatcagagtcccaatagtagcccgcatgcttcaacgcctcggcaacagaaatataagcatctttcaaagcgacgtatttaccaaccaaggcaatcttagtggtatgggtcaaatgctgaactttatgctcaagctgcgtccaagcacgcatgtcggcatcaggcacatcaaagccgaaatgatcgaccacaatctgatccatgccttgcgcttgtaatgccagcggaattgaataaagcgtctttgcatcgcgtgattcgatgaccgcattttccggaacatcagtgaaaagcgcaattttcttcttcatatcttccgtgatcggtttttcagtccggacaacgagcatattcggctgaatcccaatactacgcaattccttaacactgtgctgagttggtttcgtcttcatttcatcggccgcgcgcaagtatggtacaaggctggcatgaatatagaaaacattttccgaaccaacatcacgcttcatttggcgaatggcttcaaggaatggcaatgattcgatatcgccaaccgtaccgccgatttccgtgataatcacatcggagtcgctatgctttgcggcccgcatgatcttctctttgatcatgttggtaatgtgggggatcacttgaacggtcgcaccgaggtattcaccgcggcgttcacgttgcagaacttcagaataaattttcccggttgtgacgttgctgtacttattcaggttgatgtcaataaaccgttcataatggccaaggtcgaggtcggtctccgcgccatcgtcggtaacgaacacttcaccatgttgataagggttcatcgtcccaggatcgacattgatataagggtcgaatttttgaatggtgatcttcaaaccgcgattctttaacaaacgacctaaggatgccgcaacaatccctttacccaatgacgatacgaccccaccggtaacaaaaatatacttggtcatagccagtctccttttttaataatcgggaaaaaacaaaaacaagctccctattcatacgaacagggagcttgaaccgtattggctttacattttgtaaagcgcccaagctgtatattaactaattgtggcaaagacgtcaaggcctaaaacttaagtatgaaatgtcccaaataatcataaataacatcacgtctcaaagacagccttaaagtcagctttctgcttccgctataaatcctttaatcatggacttttctcggtcgtccctgacgatagggtgcaccattttgatgtgtgttttttgcctgctgaaaagccgcaaaccaatgtccgagtgttgttggattaatgttaagctctgcttcagctgctttcgcgaagttttcccatgctgttcgactaatttcagtattaccttgagcattgcgcgactcgcgaatgaactcgccaaccaaacggcggaacttcacttgctggtcatggctcatgcgcaaataatcttgttgcccagttgtttccatttgctggataccggttagttcacgagcatcattgtcgatcgtaaagaaggaacggatgggaatcgcaatgtacaaaatatacgctgccttgggcacaaaaatagctaaaatcataatcgcagcgatcatgataacattttctaagttgtgctccccataaatactggtataaattttccgcatttcgtctttatcattggcttgttgatgcacgattgtccttgatatgagtcgaaatacgacaattaccaaaaagtagatcgcaccatagataatcacagagatggattcaacatctcctgacatcagtcgcgtcaatgctggcaccagtgacagtaggaaaaccaagatgaattcccaaagcacgattcgtcgtggaatctgatcaacggtgctgaacaaagttgcttgctggtaccaaatattcgccacgaaacagaaactgacagcatacaccccaactgccaaaaagaaattggtaatgttggcatgatgttcccaactttgcgcaggcaactccaagaccataatggtaataataatcgcaagaatagcgtcaatgaacgtatctaaccgggttttaagttcttttgaaatcatcgtagatccccctcttgttagaaagtatcgtgctttgtcaaaaattgtcaacggtcttaaagcgtaaaagaacatttaggagcagtcaacttgtaacactcgcacttttaaggtttttaggataccacaaatagcggtaaaacacgatcatcttggtcagtatgccacttctaggatttgcctactagtggacctaaaatgagcttcataacaggctcgcagtcgcaaaaacctattcagccccaattcagaaagtatatccacagacgcagcaaactatatacgagcctccaaaactaaaacatcaaaaccaatccatgttgacctgtatcggctagtacttcgggtgctaattgcgcctgctcgcgcacacaaaaaaagccgtccccacaagacatgggcacggctcgccaaacattattttttggtgtcgctatcgtcatcatcatctgaatcgctgtcgtcatcatcgtcatcagagaagtcagcggtgatgtcatcgttatcatcatcatcctcgctgtcgtcatcgccgaattcggctagctgaccttcgataccatctggcaacccatcatctgggtcgtcatcactgtcatcgtctgtgtcagtcgtcttcccgaccttgtcgtggaagcctgagtcatcgtcatcgaaatcatcgtcgtcatcgctatctgcgtcgagatcctcatcttcaggatcatcatcgttatagtcgatcacgtcatcatcgtcggcaacgtctgctaagaaggcattgaccttcttacgcttcttacgacgtggtgcctcttcttcatcttccggatggttaacttcttcatcaacggaatcgtatggataccaagcgcgcaggccccaaacgttatcgcctaaagaaatgaaactgccatccacgttcagatccgtgtagaattgcggtaaacgttcacgaatttcttcgtcacgcttaccaagataattctggatctcgttggccagatcaacgaacgccatggtatcccctttttctttgaggatctcatgggctacttcgatcattgataattctgatttatcggcattggcaaatgctttgagtttcaaccgatacacgccctttccacagtttatacagtctgtttttcatcatacacgctcaggcgttgaattgcaatctcaatcgataatcacccaagtgctggttattagcaaaaagttgatattcaatgtagacttcacctgccacaggttcagttgtcatgcgcacgtcaatccgtggcgtgaccgtttcaaccggaatgataccgtacggtgtgcgatagcgcgtcagcacgcgcttttcattggcaaagaacagtttcagctgagtgtcgccgttgctgctgccacgcgacaactgaacatcgccatcttcacgcagcttcatcgtcaccggcatactggtcccagcatcttcgtcaacttcttggtaacgaatgtataaagcgtttcccatctgcaccaacgttccaggttcgtcaaaaacatgtgtctcattgtcctcaccctgcgtcacaaacgtctcaaggtgaatttgaatcggcactccttgtgaaagatccataatgtcaatcctttctaacagctattgtacgcccacgggtcaaactggtcgagtcgtaacaattatccatgtttcaaatcacttactgcaagatatgcaatgaaaatgcagttccaactgacgtggcttgttaccttagttataatataagtaatctatcatatagaaagaaggcgcgtgatggacttgacaacactggccggccagcaggcagcaatttttcagcaaaattttacaaaagacgaggcgccgctcagttttgcccatactaacgcgttattggcacatcctgaattgcacccgcctttgatgctgcatttctggacggcagaccaaaccgtcattctaggcatgcaagatctaaaattgccgcaactcggtcgtggattgcgggtattggcaagtgatggctatggtttcttcgttcgtaattctggcggtttagcggtcattgcagaccgtggggttttgaatgtatcactatttttgccaaatgaagacgagctttcaattaacggcgcatacgagttgatgactcagcttttccgcaccgcgtttccgagtctgccaattgcgaccactgaaatcgtccactcttattgtcccggtaaatacgacttaagtgttcgcggacaaaagtttgcgggcatggcccaacgccgtaatcgcgccggcatcgttgtgatgctttattgcagtattttcggtaatcaagacgctcgttgtgccttgcttcggcgattctatcatgaaggcaaggctgctgccagctcacattttaccttccccgtgattcgatccgaaaccatgacgactcttagcgacttgctgggacgaccgttaacgcttgagcaagcaacggtcgccttgctaaatgccttggctgacactggcatcgccgctgatatgaattcaatgccaacccttttgcgcgatccagcttaccataaggcgctgacagaagcgactgccgatttgcacacgcgcaatcgcagcctaaaaaagatgggagaacatgatgctatttgaaaagttacctcgcgaaaaagtctttcgcgatccagttcataattatgtccatgtgcaacatcgcgtcattctggacctgattaataccccagaatttcagcgattacgccgcattaaacagctcggcgtttctgattatgtttttcaaggcgccgaacatactaggtttgcccattcacttggtgtttatgaaattgcccgtgagatgtgtgacaactttgtcaacaactatccgacacaaacacctggcgatggcctatgggatgacgccgaacggccagtcgtgttatgtgccgccttgctgcacgatatcggccatggtgcctattcgcatacatttgagcacattttcgacaccgatcacgaggcgattacgcgagcaattctcacggatccgcatacgaacgtgaacaaaattctgcgtggtgtcggtccggaatttcctgagatggtcgcatcggttatcaaccacacctatccgaatccgcaagtcgtgcaaatgatctccagtcagattgatgctgatcggatggattatttgttgcacgatgcttattacaccggcacgaagtatggtctcttcgacctttcgcgaattctgcgagtcatgcgaccatactcggatggcatcgcttatgaagccaacggcatgcatgcggtcgaagattatgttgtcagtcggtttcagatgtaccagcaggtttatttccaccctgtgtctcgtggcatggaagtcattcttttccatctgctaaaacgtgccaaattcctgtatgagtctggtcagtttgaatctggcttttcgccgcggctactcgtgccattttttgaacaaacttttaacctcaccgactatttgaaactcgacgatggcgtgttaaacacttacttcacttactggctagattatccagacagtatcttaagcgattttgctgatcgcttcttgaaccgccgaccactgaagtctgtgacctttactgaccaaacagcctatctcttgccacgcttaagggatttggtagcatcagccggctttgacccgcactactacacagcggaaaatgatagttttgacttaccatatgaccaatacgacccagcttccgcaaatccaaaaacgcaaatcgagatcatgcaaaaagatgggacgcttgaggagctctccaccctatcaccgttagtcgcggcacttagcggtcgggcaaccggtgacaaacggttctactttccaaaagaaatgctagccacgcaagacagtaacctgttttcgccaatttatgaaaagttccagcattatctgctgaatggcggtctcattgatccacactttaacgattgatgactgccttatcgcttaggttgattggctagccatttggcaactgcccaacggtgggtcggtcgtttcagctcagcgagggctaggtcaatcggcattaacatcaaggtattaaaagtttccagcggatcttgtacaaacgccaattgatcacaagcaaaaaaagttgccggatgatagtaagctgtttgacggtgatgagagtaaaaatattcagatgacttgcccaacttttgggtgacatgaacggttgccccaaattcttctaacagttcgcgtgccaacgtgacttctggcgtttcgccttcctcgacgccgccgcccggcaagaataaggcgtggttaggcgcctgcagaatcagcaaccgagcgccactatgatccggtatgacgccatatgcgccaatccgggtatgataatctaactttggatcttttcggccaaacacaggatcgatcatgttgattacctccgcttttaatcacattataccctaatcattttttaacctctacacaaggagactttccaatgtcagctcaggaactttttattgtttttgcgataccgatcgtattaggtgtcatcttcgcttttagtttcaccgtggagccgcgacggttgattaatggtgtcttgtttaatttttttgcggtcacgtttcttgtggcgttagcgattgccattttaaggtcaggcaatttgttgctaatatcggtcaccggcgtattgttcctgatcattattttgatcgttgccttgctctttgcgttgcatttattctggttgttgtggaatgccattctggtttggcgtcgtgaaggtcattcattgagcaatatgctgactttatatattgcaattggtttgttgctgatcgaaattgctgcttcttttggtcgccggttcattcctgatccgttgtacttctctcttgcaatcttttttggtctcggcggcttttatgtgctcttaacgttgtataattttcttacagttttgattctgtataactttcgtccgcaaccgcacaatcgtacatttctcattgtgctgggcgccggtttgttacatggcgaccaagtttcaccgttgctagcgagccgaatcgatgctgcgatcaagttctatcgcaaacaaatcaaaaagggccgaccagcgccgcgaattattttttctggcggtaaggggagcgatgaggccatctcagaagcgatggccatgcaacgatacgctttaggaaaaggcatccctgaaggtgacacgcttcttgaggatcagtcaaccaccacattggaaaatatgcaattttccaaacgtctcattactcaagaaattggtgaatcaccttataaggctagctttttcacaaataattaccatttgtttcgtgcaggcatctttgcccgcatggctggcattgccgccaatggtgtcggcggcgcgacttcgttctacttcctacccaatgcggtgattcgcgaatacctcgccttagtggttctatataagcgacggcatgctgtcgcatttggcctcattgtcttgattgcgattgctgaattcttacgggtttggcatctgggataagccgcagagatgcagcataagtgttgatttcagtatactaattttgaagggagttactgtttatgttaaaagaatttcagaaatttatcatgcgaggtaacgtgctagacttagccgttggggtcatcatcggcagtgccttcactggtttagtcacctctttaactaaaaaccttatcaacccgattttatccatgtttgcgggcaaagctgacctcagcgggctttatttcacgatattgggcgccaagtttacatatgggaattttatcaatgacgtgctcaacttcttgattattgcttttgtagtctttctgctagtcaaaggtattaaccgcattttaccgtcaaaaccggccaaaccagctggtccgacacaagaagaattgctaacagaaattcgcgatctgttaaagcaagatcaacaggtctaataacctaaaataatcatcttgtacaacgctttatcccataaatataaaaagtggcctcgttgcagtatttgcgcggggccactttttatatgaataattgaatattaacgcttgtttgacaacttggttctttaccaaaagcttagagtttcatagctgtacattaatttaaattcaacaaatggggtttgggacattgacaaacaatgtcatcaattctaatgtggtttgtttaatcttcggggttatcgcgcatcaaatcggttttcttgaggacaatgctttgaacaaggctggcgtctttaactggttgatgtacggcttgctcgcctatgtctttggtcaactgagtgccaccacgccagctgtgcttggtggtattgtcctccaaatcattgtcctaattgccttgggcgttctgggcatgttcttagcatcgcggcttcttgctaaaccattcggtatgtcttggcaaatggcattttcttgctcgctgacagctctttttggtttcccagcggactacatcctgacttcggaagtggcgcgagcgatggcaacaaccgaagatgaagaggaatacttaacccaacaaatgatgccgaagatgctggttggcggatttgccacagtttccgtcgcctcagtcatcatcgccaccatcttcttaaaactgctctgataaattggcacagtatttacaccggtagcttgaaaaaatgacagtcattggtgacttctaagaaagcattcaaaagtctggtttattgatcatcaacgcacataaaaagcgacagtcatcctaatctatttcagatgatgactgtcgcttttgtcattgtcattaaaatgctggttgtaaatgaatggccaaaacaccaaagcttgcttcctgccatgctgtgtatagctgatacgtatctgcaaccattttcgtttcggaatccgttggtgcactgcctacctgcggaccgcgatatttgtgatacaactcagcaaaactggtgaatttttccagggcacctactgtcctgcgctgtgtttgtgccgttgtggtgtcttcaaacacaatcgtatcgccaacttttaattgttgccgtttttcatcattgagtctgatctcaatcgttttgctgccttgtttgactaacaaaaactgatcgtgagctaatcccattcgcatctgccggttgtgcccccttttcagctaatctcagtggctgttaatctaatgacgctttgtctgatgcaagtagttggttactgtctcggcaaacaaaactaacggtggatccagcagtagaacggaatagaaaaaggtcaccaacatcaccaatcaagcatttacacgatagtcgctatgcaacttttcacattatatgaatttcttgcgactatatgtcgtttatttgcttcaacaccaatgatgcaggtaaataaaaaagccgtacctgaatataggtgcagcttttttagtactatttcgtaaaccgattttcaaacaacggtgtcacggaacgattttcctgaatccgcatgatggcgcgacccatcagcggaccaactgaaaccacatccagtttatccatatgcttgtcagctggaagattaatggagtcagtcacaacaaccttttcaatagctgagtgggtcaagcgttcaactgccggaccagagaagatggcatgggtcgcggccacgagcacttcggtcgcaccggcatccttcaatgcttgagcagcgagcgtaatggtgcctgcagtgtcaatcatgtcatcaatgatgatacattgtttgccagtaacattaccaacaatattcatcacttccgcaacattcggacgcggacggcgcttgtcaatgatcgcaatcggtgccttcaagaattctgctagttttcgggcacgggtaacaccgccatggtcaggtgacacgacaacggtgtcggcaccatcgtagtgattccgtaagaagtaatctgccaacaatggggcgccgacaagatggtcaaccggaatatcgaaaaatccttgaatctgcgcggcatgcaggtccagcgccaaaacacgtgtggcgccggcacgttctaacatgttggcaacaagcttggctgtgatcggttcccgtgaacgggctttccgatcctgacgggcataaccgtaataaggcataaccacgttgatcgtatgcgcagaagcgcggcgcaaagcatcgatcataatcaacagttccatcaagttgtcgttaaccgggctggaagtggattggatgagataaacatcatccccacgaatactttcttcgatgttgatttgaatttcaccatcgctgaaccgcttaaccgacgactttcctagtttcacaccgacctcggcagcgattttctctgccaacggcttgttcgaattcaaagcaaaaatctttaatctcgggtcaccgtattgctcagacatatgttcctccacgaattgttatgggctgcgaaaaattgttccacagaaatcttagcggactgacgaaaaaaagcaagcacatgaatagaattataacctaattccaatctggatcttttgccagcggcaggcgtttccaaaaatcatctttgttggtttgtcgtgcgcgggcgatggccatcgcgtgaaacgggacatcttttgtgatcgttgaaccagcagcaataaagctatggtcagcaacatccactggcgccacaatattggaatttgaaccgataaaggcatgatcgccaatcttgctttcccacttctgaacgccatcatagttgacgaaaacaacgccgcaaccaacattaatatccgttcccaaggtcgcattgccaacatacgttaaatgaccaactttggtgcgggcaccgatcttggcttttttaatttcgacaaaattgcctagatggacgtattcgccgatgtcagcatcaggccgcagatgcgaatttggaccaatgtcactatgagcgtgcatcacggcatgctcgatggttgaactagttactgtgacatcattttccagtgtggcatcgactagttcagagtgggtaccaatatggcagtcttcgccaatgactgttttccccttcaagtaaacaccgggttcaatcacggtatcggcaccgattttgacctcggtatcgatataagtcgttgctgggtcaattaaggtcacaccattgcgcatatgctgttcattaatgcgctgctgcatcaggcgggttgcccgcgccaatgcgacccgatcattgacgcccaatgattcggtataatctggcatctgataggcagccactttttcgccagcgtcgcgcaaaatacctagtacatctggcaaataatactcgccttgggcattattattattcacttgatgcaacgccttgaacagagcctggttgtcaaagacatagacgccggtattgatttcagaaatcaatgcctcttccggcgttgcatctttttgttctacattcttcacgacattgccgtctgagtcgcgaataatgcggccgtaaccagttggatcaggagcactggcagtcaaaatagtcgcctttgcgcccttggcttcgtgataagcaaataaatcattcaacgttttggcggtaaacaatggcgtatcaccactgataatgagggttgcgccttctttttgaccaagtaacggttcagcttgtaaaacggcatgtccagttcccaactgttcagattgcaaaacaaacttcgtgcgcttgcctagcgtttcttcaactgcttctgcgccatggccaacaattgttacaatggcatcgggatggatggcttccacctgactcaccacatgctcgaccatacttttgccacagaccggctgtaaaaccttgtaatactttgatttcatccgcgtccctttaccggccgcaagaataatggtgaatttctttgacatgtttatgctccaatcctaatattctgtcttcatgatagcccagccacgggaagctgacaacaagtgggtggcttgtgtctgtggctgtccacaacaacagacccatgttgccacgggtctgttgttgactatgattggcttatgacttttgtatgtcatcgtcattggctgaatcctgcctagcaacaggattttttggttgtgactggaaggtgctaatttgggtggtatcggtccatgcatcgtaaaagaaacggtgatgacgcgaaatgatttcccatgcaaaattgatgagaaagagtagcgacaagaggccaaagaatcccagcgccgctaaattgatttcggttcgatggaaggcgccgaaatactcgccaaaaaagtaattcaatcccataaagctcggcaaagccagcccgtaaagcagactctcacgtaaaaagagacgccagaacccaatcggctggccatttgtccgaactattttgattcgtacaagactttttcccagtgtctgcccttgattaaatgcaggccaaagaacaaagacaaagaatagcggcaggacataattgccgagaaaacctggtagctgatccagtcccagcaaatgcagcaggatttgaattaacacgccaataatcccactgaagagaaagaaatcaatgataaacgcagcaaatcggcgagccaaagtcacccgagcaccgcgcgcctgaattttcgcatcaatgatgtcccgtgacggcaacgcgcgcatcagaattggtgcaaacacaccgcccaaaaagccgcctgtcgtattcaaaatcaggtcatcaacgtcaaaaagtcgatacggacgcggataataaccgtagagtcctgacaattgcgtcagttcgaagaataaacttaggccaaaactcatcaagataatctgcggcacgctgcgtttgaagtaatagcgcaagtaaaagccaaacggaatcgtcaaaacgacgttaaagaacggctgaatgaaagcggattgctttaacgctgccaaccaagtatgcggattggttggcacgaacacggttgtatgcacgaaataacgcaacgccatgaagggttccagattatatttaggcccggtgaactgcgcaactgctgctcgcgaaggcaacggcaaaataatcaaaaagtaggctgatagcagataaaagacgaacgagtagatcacgactgcacgccaccagctaaaggcaccgtaccgtcgataaacgacgaccagaaatggtaatgccaacaccagcgctaaaaacggaaacgtgatgatcgcagttctgaccggtccgagataagcactcattgaccagccacctcgagtagttgacgattctgatctagaaaattgccagctgtggcatgaagcgtattggctttagtgtccaccttgtcaacccgaatcaatgatgtatattcactgaccatccgatcaccgtcgaacttaccttcagcgaaaaccgtaataccgaccattttggcattgaattcatcaatcagagccttcatgccattgacggtgccgccgcccttcatgaagtcgtccacaatcagaactcttgagttagctggcaagctgcgtttactcagttccatcttttcaattcgcgcagatgaaccggacacatagttcacggacactgtggaaccttccgtaatcttggagtcacggcgcacaatcacaaacggcacattcagatactgactaacactttgcgcaattggaatacctttggttgcaaccgtcatgacagcatcgacatgggcctcgcgatattgggtggcaattaatcgcccaatttgccgtagcacactgggtgttcctaacagatcggaaagataaacgtagccgcctggcaataagcgatctgtctcggataaacgtttggacattgcggcaataaagttttccgcctcatcttctcccatgatcggaatatagcgcacaccgcctgctgcgcctggcaccgtttcaagaatgcccgtctgtcgctgggcaaatgttcgccggacaatagccagatcttcactgatagaagacttcgcactctcataccgttttgagaaaaaagtcagtggaatcaaggtatgcggtcgttctaataaataccgggtcatatcaattaaccggtcacttcgtcttactttcatcatttcgctcctaacaccgaatatttagcactacactaacattgcgtgatgatctcaacaagtataaacgttttaaccgaaaatttcgacccttttgcgttgttttttcaacgaacgttcgcatttgctcatcttgtgtttctttttaacggaaaaattgctacgtctgattggcttcttacgccattctatattagaatgattataaagaggaaaaatgaggagggcaaaccatgaattgttttgaactgagtcatgtgacgtttgcgccggaaaaaaatgcgatcctgcatgacatcaatctgacgattccgtggggtgcagatcttaccattgccggtcattcgggttcaggaaaaagcaccttgcttcgtctgctggcgacgctgctaacaccaacgagcggaaccattcgctataatggcaaaccgcaggacgattatgatccgatcagttatcgccgcgaagtttcttattgtgcgcagcagcccgcgttgtttcatggcaccgttgctgatgatctgcagtttccattcaccattcgtcatcaaaaaatgccccgtgaagaagccgagcgtgctttagaaagcgttgatttagccaaaaccatgctcgacgatccggtcaaaaacctttccggcggcgaacgtcagcgagtggcgttgttgcggcatcttttctttccgccaaaagtgctgttacttgacgaagtgactgctgggttagatcctgacaccaaaacggtcattcatgccttattacaaaaacaaaatgaccaaggcatcaccttgatccgcgtcactcatgatgaaggcgagattcaggccgcgaaacaattgctgcggctagttgccggacaattcgaggaggccgctcatgagtaatcagctcattgtgtcacccatcaccttattgctagcacttatcttggtcttgattgcactagcgatcaacctaaaagaagatctcggcatgaccaaagatttgattatcggcgttgtgcgggctgtcatccagttgactgttgttggtttcgtcctgacctacatcatcaaagccgatactgtctggctgacgttggccatgattgcggtcatcatttttaacgccgcttggaacgctaaaaaacgcgccgggacaattccaaatgcgctcgtgacgagtttgttggcgatcaccaccgcgactgggttaacgctggtgatgctggtcgcggtcaaagccatccgttttgtcccgtcacaaatcgtcccaatttgcggcatgatcgccagcaacgttatggtggcaattggcttggcttatcgcagtttgaatacagaattcaatgatttacggcaacaggtccttgaacgtttggcactcggcgctgatctcaagcaagccagtcaatcgctcattgtcaatgcaattaaaactgggatggcgccgacgattgattcagcaaaaacggtagggttggtcagcttgccggggatgatgtcggggttgattttcgcgggtattgatcccaccaaagccatcatgtatcagatcatggtcacctttatgttactgggcgccaccagtatcggtagctttattgccgtttaccgcagctatccacgcttttataatgcccgtaaacaactgcgctaaaaaatcgtccaacgaatcatttgacaaccacataaaaaacgttgtgctcgcattggccatgcggacacaacgttttttaaattacttgattaataagggttctccattttattttgcggctcgtatggaccatactcaacctgaatcgtcgtgtgcgcaatatcaaagctttcgcgcaaagataggctgagcgcatcgaggaagtcgtcattgccaactgtggtcgtgcgcacgacatggacggtcagcgccacatcggtcgtgctcaatgcccaaatatgcaggtcgtggcaagaagcaacggttgggtaagcattcacgagctttttaaccgccactgggtcaatatcttttggcactgctgccatggcaaggttgaccgcatcgcgcagcaaattccaggtgccaaccaaaacgacaatggcaactaagatcgacatcacgggatcaagccattcccagccagtcagcaaaatcagtccgccggcaagaacaacgccaagcgaaacgccagcatcggcggccatatgcatgaaagcgccgcgaatattcaagtcatgttgcgaaccgccatggaatagcaaggcggtggcgccgttgacaataatcccaacgcccgccaccagcatcatccagccgccttcaacaggtgcattttgtgagagtcgggtgaccgcctcaacaatgatggcacccatagccactaataagaacgcggcattagccaaagctgccaaaatcgaagaactcttataaccataagtccgttcgacagtgggatgccgtcctgacagccaatctgcgaaccacgctaatccgagtcccaacacatcgcctaagttgtgaaccgcatctgcgaccaaggccaccgatccaatgccgatgccaaaggctacttcagcaataatataaattgtattcagtaaaatgccccagaagaatgccttgtttggttgaacttgttccatgacaaccgcccctccattttcctatccccatcatggtttagcgttacctaaaaatcaacccctaaaccgtggacccgtggcggataagcaaaatggccgtaataggtaaacttcgcggcaaaagcccttcatgctgttataaacccgcatggctctggagtgcttttggcacagaccaaaaacagttgggccgctgcctgacatttgcgcgaattcggcaccatacttttgtagccgctgcttgagggcggtcatttccggataccgactagcagtgatggcttcaaggctattcgccatgccactcgtcatttgtgcaaagtcatgattttgaatgcctgccaccacagtttgcgtatcaggatggcgcagaccggcgtcataatcaatggcattcaaaatggtcggcgtcgatactgaaacgcgaggctttgccaacacgacccaaaaattcggcaagctgccaagtggggtgaccacatcaccgcgaccagttacgagcgccgtctctgaataaacacagtaagggacatcactatcaacacttaagccgatccgtgctaattgtgaccgactataaccgagttgccaaagcgaattcaaccctcgcaaaacggcggctgcatcacttgagccgccgccaagccccgcggcgaccggaatatgtttttcaatatgaatccgcgcaccttgacggatattggcgtgacgctgcagcgccaacgctgctttgtaggccagattgcgcggatcttcaggtaggaagccgctatctgtcgaaacctgaatgctgcgatgcgggctaatcatcacatagtcagctaaatcgaccgatgtcatgaccatctgccactcatgttcgccgtcgtcatggcgatacaaggcatccaagctgagattaatcttggccggtgctttttcgatcagttccatccaaccaccagtctctggcgacccatacgcttgccggtcaatcactatcaccgcaagccccgttgtatgcatcgaccgtatagttatttttagtatactgttttatgcgctgattttcaccgatacacggtaaaaatcgcgtaacgatgcgtgacttgctgtttccgtatccgaaatgaaaaacagcaaaagacctcgatgcaactcacatcgaggtcttcttataacagatttaattgttaaaacaattcaatgttatgaggctttttcttcgccttcgaaggtgatctgaattgacttagtcaagagatccgcgtaactgtaggagacgcgctcgaacgcattttcatcttggtcgagatcgaccacaaaaatagccggataggtttctttcaaagtcccccgtcgccgcgtcactttcttgcgtccagcttgtgcaacgaccgttaagttctcaccgatttttccatcgagcttccgtttgatgcttgctagtgtgattggcatgcacttcacctcttgcagtctatcatagcacgaaagcaagaaatttgcaattataccacgcgtttcttatttcggcaagcgatttatgctggtgttttcagtaaaaatttatcgtgcttaagcgtgagcctgactgattaaatccgccgctcgcaaagcacgatctaaccgagcaaaatcagcaattgaaagccgctctgcgcgggtaccagggtcgatggcggcggttgttaaagcagatcgaatggcagccttgttagttttgccaaataagaccacaagattattccagagtgtttttcgccgtgaagcaaaagcgccgcgaactagccgatcaaaactggctggatcggttaaagctgcaagcggttcggtgcgctgcgtcaaggtgacaatggctgaatcgacattgggtgccggtacgaaggcatggcggcttaccgtgaaagcagttgccacgctcgcaacgagttgaactgcaatactcaggctaccatattcttttgaccccggcgttgcgcttaatcgttctgccacttctttttgcatcataaccgtcatgctatgaagtggtagctgtgcgcgtaaaagatggagcaaaatgggtgtggtgatgtaatacggcagattggcaacaacctttaaggtgtgcttgccatcaaaatgctcggcaaccaatgcgcctaggtcggtttttaaaacatcctcattcacgaccgtcgcattaggataatcggccaatgtttcatccagaatcggcagcaaccgatcatcaatttcaagtgccaccacctgatgcgcgctgtccgctaagaattgggtcaaagcaccaatccctgggccgatttcgatcacatcatcctcaggggtcaaatcggcggctgtcacaattttttgcaaaatcttggagtcggtcaaaaaattctgacctaagcctttgcgcatatggaaaccatggcgctttaaaatagcgttggtgactgctggctgcgcaactttttcaggttttgtcatgctgtcctccatctacttgggccatggcagccaaaaaagctgcgcggctaatttgaaactctgcgagtcgtcgaagcaactgtttgccatttgtgtagccaatatgcaacaactcgcctaactgttcccgacgttggcgggcaccgacaccaccgactaaatcagcagcgagcaaatcttgctgactaatcacttgcggtgcatctggcatttctgtaaaaagatgctgcaaagctgcgcgcaacgcggcaggcttggcatgttcgatgcccaacgagcctttatgatccggcacaccttcacgacgcggcaagaaagcatgcgtcacccctggaaccgcgcgggaaatagttttgcggattttctcacctgggaaatcagggtcggtcagcacaatcacaccgcgtttagcctgtgcttgccgaatgcgttcgagcgttgcctcgtcaattgcactgccgcgggtttcaatggtgtcaatggcaccaaaagtttctttcaatcttttcgtatcatcgcggccttcaacgaccacgacttgtttgatagttgtcatgctttttcctttaatccaaagatgcgatgggcattgtcccatgtttgcttggcaatcacttccggcgtcgtttcacgtaatttcgccaaggcctccaccacataccgcgtgtagcccggttgattctgccggccacgatagggtgtcggcgtgagataaggcgcatccgtttccactaacagtcgatcattgggcacaattttggcactggcatgttcttccggtgcatttttaaagctgacaatgccagagtatgaaatgtataagcccagatccagaaaacgttgaccccaagttgcatcgccggtgaagctatgcatgatcgcgccgaagtcttcaacatgagccttttttaagatgtcataggtatcgtcaaaggcatcgcgactgtgaattgacaccggtattttcagcgaacgtgcaatctcaagttgccgacgaaaaacccgtcgctgaatttcccgtggcgaggtatcccagtgataatctaagccgatttcgcctaatgctacaactttagaatccgccagttgcttgattaacaacgcctctttggccgcgtcataatccttgctagactcgggatgccaaccaacaatggcatataaattgtcatactggtgggccaacgccaatgcgccggcattcaaagctgtgtcagagccgacaatcgccatcttcttgacaccgagttgccgagcgttttcgatatactcggcttctttgccttgatagggcgtgtcattcaaatgggtgtgtgaatcaaaaatatccatgcgatctcaactttcttttatgcttctgtcataagcggtgtcagcaaccgtgcaacttgaacggcttttttggcagcaaatagtcgcttcaattgcgcagctggcgattgcgttaaagcgcgaatcaactgtgccatgcgttccggttgtttctgcggctcagcattcatgagcatgaacacccagttcactggtagaatccgactagcatcggctaaatctttgaaggcgactggaatagcaaaatgaacaaccaccaaccgcgtttgtttcactaattcgccttccaaatgcggaatggcaatattcggcaagccatctgccacttcatttagttgcatgccagaaggaaatgtctgctcgcgtgtgatcaacgcttctttcccagccggcgccataatttgctggtcaacaagtgctgtgctaatcgttttaaaaaaagctgcctgcgtgggtgtattcagaaaatagaccagctctggcgtgatcaaatcagtcatgcatttcacctatctttacaaattctcaatatgtttagagtatagcacgcagtttgcctaggctcatcgtcgggtgatcatttcaagaaaccatttattatccgcgctttttctttgattttcatgaaaatgctccgcgaaaaatgtctattacttctattttgttctatactatggaggtactgaacatttaaggattacctaggaggtatttttacatgtctgttaaacttactgctggtcagttgaagcacttgaagcaattgtcaaacgatgacaatgtgatctcagctttggccattgaccaacgcggttccctgaagaagatgcttgcagctgcagctaacaagccggctgatgaaaccacgattgttgatttcaagaaggcagtctctgaagaattaaccaaatacgccagcgctattctgcttgacccagaatatggcttgccggctgctaaggttcgcgatcctaagtctggcctactcctttcatatgaaaagactggttacgatgctaccgaacctggccgtttcccagatctgatcgacaaccaaagtgctttgcgcattaagaacgaaggcggcgacgctgttaagttcttgctctacatcgatccggatgaaccagacgctatcaatgatcgcaagtatgctttcgttgaacgtgttggtgctgaagcaaaggctaatgacctgccactgttccttgaattggtttcttacgatggtaagaccaacgaaactggtacagctgcatgggctaaagctaagcctgaaaaggtcatcaagatcaccaaggaattcagcaagccgcaatacaatgtttctgttttgaagcttgaagttccagttgatcaaaagtttgttgaaggctacaccgatgacggcgttacccctgtttacagcaaggaagaagccgctaagtattacaaggaacagtcagatgcaacggatctcccattcatcttcctgtccgctggtgtcaccaacgaattgttccttgaagaactcaagtttgctaagcaagcaggttcagcctttaatggtgttctctgtggccgtgcaacttggaagccgggtgttaagccatatgctgctgaaggcgaagctgctggtaagaagtggctgcagaccgaaggcaaggctaacattgatcgtttgaacaaggtgcttgcagaaactgcaaccccttggactgacaaagttgaaggttaatctttaaccatagttgcaagaaaggaccgattatgatgatcggttctttttttatgactgcggacatgtttttgtgaccactgcaaacatcaaaatgaagttcaaaaaacttgataacaatcattacaggttagtgatccagtggtagactggtattgaatgcgttttcgtctattaggaggtaattcaacttgatcacaattgaaaacagcaaatttaaagcaggcattgccgagcgcggtgctgaattgcagtcgttggtaaacaaagccgacaactatgagtatgtctggacaggtgacaagactttttggaatcggcatgcgcctattctgttcccatctatcggaaaatcaaatcaggaccaatatcgtttaggcgcaaaaacctatccaatgagtcagcatggatttgctcgtgactatgactttgatgtcagcgataagagcgactcagcggtcaccttcacgcaacatcaaaatgctgagacattgaagaagttcccgtttgagtataccttggctgtcacttacatgttgacggacggcggcctcagcgtacattacacggtcacaaatgacgatactaaatcaatgccatttgctttagggttccaccctgcctttaatgtcggcttgaaagctgatggcagtttcgacgattacgacctcactgttgaaccattaaacagcccactacaacggttcggcatcggccctgtgccattccgcaatggcgatgttgaggacatccccggcgcagaaggcaatcgtttgcccctgacacatgatcttcttgatggtggtctcgtgattctcgctaacagcgaaattgccaaggcaaccctcgcatcaccgcaccatgaccacagcatcaccctcgatatcagcgactttccatatctcaccatctggagcccagaacataaaaaggcacctttcatcgccgttgagccattcgatggtctgccagatcaagctggcgaaccaaccgactggtacaccaagctcggcaacaccacgctatctgctggtgccaacaagcaattggccttgaaggttgagcttcactaatcgaagtttaccacccaatcgttcgacacaattcgggcgatttttttgtgagcgcggaacagctcggtagcaaccgaagtgtcagcagtcaaaaaaagctgactcaccctagctagctttctggaaaagcgaccaaatgattggtacagttgcagtacaatgaactaaattcagaaaaggaggcctctatccatgcacattgccatcattgacgatcagacagccacgcggcaagcaacaacccagctgcttagccaactgaccacgcccacgcaacctttacaagtgacggcttatccaactgcagaggcctttctttttgctgatcagcctgccgatctgttgttgcttgatatcaagttaggttcaggcatggatgggatgacgttagcgaaacagatccgggaacatgacgcggccacggcgattgcgtttgtcagtaactatgatgaattcgtttttgacggttatgatgtcaacgcaattgattatgtcatcaagccgctcacaagtgacaagctgcagcatctcatcaccaaagtcgccgcgcaaacgcaaccaaagctgttagccttcaccaccgccaacggcattcagcgtgtcgccatgtatgatatcagtgccatcgaagtaaccgatcatcgcttgcaggtgcacacccagaaaatgacgtacacagttgccggtcagttaaaagacttcctgcctcagctcgatgataattttattcaaatctatcgatcaattgtgatcaacctcaactttttgtcgcagcttgagaaaaacaccgtcgtcatggctgatggcaccagttacccggtttcacgacaacaagcaccgctcgtcaaacaagccttctttaaacattttcgggggttagctcatgacagtgaatgaatggtggtggctagccgcatttggcctgctggcaattggctgttgcgtgattttatggtggaccttccgccgacaacaaaattggcctgtgcgcggtttgaatctggctgtcacattgctggccttgggtggttggtggctttggccgctgccaagtgtgcggcttgtgcttttttgcagcacctttttgaccggcagcttggagttcgtcttaatgcgtcaattcctcaacgatcaggacgccgtattcgcccacagcctcgataaaatgatggcccaatattcgcaagaagtacaggaactttatgccaatatgcgcggatggcgccatgattaccatgatcatctgcaggcgctcaaagcctacttagataatcaggatacgcaggcagcccgagcctatctcgacgaactagaagacaaactggacgaagttgatccgctcgtccattctggcaatgcgatgttggacgctatcgtcaatgctaagctgacattggccgaacggttgcacatccccgtcaatgaaaaagtgattgtcggcagcacgccgttaattaaagatgtcgatttggttgtcatcttgggaaacctgttagacaacgccattgaagcaatcagtgagcaaccggccggtgagccgcgccaactgcggttgtatatcggcatcgtcaagcaacagttttacatctccgttaccaacacccggcctgccgatcaagaaatcgattatcagtacgcctcaaccaaaagtgacaaacgcggcctcggtatccggcgcgtcaacaaactcgtggccaagtataatggcatgatcaatcgccaatatgaagcttccgtctttgtcaccgagattgcgattcccattcacgccgttaaatcgaccactcacgcataatctgccgcgagtggccgattttttgctagattaagatcaacgaggtgattgacatgaaaaaatacgggttgttcaacaacttacggtggtacttaacttacttgcgaaaagatgaaccgtcacttgcttggaccgcaactggtctcgccattgataaagcggccgcatccttgctcggggttttcaccccagcattgttggtcggtgccattgtgcagcatgcgacactgggggaatttgcttggttggccggtttaaccggcttgggattagccattaccagtgaagttgattatcttttaatgacccacgataacgttaaaagcaccaaattacgtaccgtcattgagatggactttcatcagaaacaatgggatctggattatgaccaaatcagcagcggcaaagttcaagggttggcgcacaccgctttcagtaaagggttgagttggacatatgctggggcagaggctatttatatttttggccgtggctccttaattgatatcgcgaccttgttagtattccttgcaactttgtcggccgtcattccgtgggtgtttgcattggttcttctcagcgctgccatcagttatgccgggctgagctggtaccgcaagtggtatcaaacaaacaacgtcaattggaataagctcagccgccagcaagcttatatctcccgcaatgcctatgcgcttgaaaacggtaaggatattcggatgtttgggatggctggttggtatcacacccatcttgatcgactcctttcacttcaagatgcttggcaacgccgcaactcattgcggcatttcttaggggcacaggttggtgaacttgccggattatgtcgcgatgccttggtctacgggagtttagttattgccgtcacccaaggcagcctatccattgctcaatttactttgatgtttggcatgacaagtggcttcatcaccttacttgaccaattactgaaagatttcagtggtttgcaaactgctagtatcgatctgcaagaacttcgcgaattcatgacgcttaagccgcgaacaccagcacgcccgctcaccacttccgaacaaacacaactaaggcagcgaccggtcaccattcattttgaccatgtaaccttccgctatcccgaagctaaaaccgcgagtctcaaggatgtcagctttacgttagaagccggccaaaagcttgccatcgtcggcgtcaatggcgcaggtaaatcaactctcgctcgtttgatgatgggcttgttacacccaacaagcggcaccattctgatcaacggcttaaacgccgatctattaccactagcaactcgtttttcattgttcgcccccgtctttcaggaaaccatcgttctagcattgagcctcgctgacaacgtggcattgacgaatccgccgcaacctcaacgagtcgagtcagcattaaaagacgcgggtctagctgattttgttgtgacgttgccacaaaaagctcatacacctatgacccgatacactcgcgatgatggcatcgaactttcaggcggtcagtcccagaaacttatgttagcacgcgcactgtataaagatgctcctgtcttggtgttagacgaaccaacagcggctttagatgccatcgccgaaaacgaggtttaccaagagtatgctcaattagcctcggggaaaacttctctgttcatctcgcatcgactcgcctcaacccgtttctgtgacgccattctcttcatggatcacggtcaagtgcttgaatcagggacgcatgaccaattgatcgcaaacaatggtcgttatgcgcaaatgtatcatattcaaagtaaatactatcaacctgaagcaaaggaggttccagccaatgacaacctttaaagacgccgaaaaaaagaagccagcaagtaatacggtagtccgagctttacgtgtggttcgggtcatttatgaactcgactcagccgctctgccagttgaatttatgcgtgccctcacaaccgtgggaatcccttatctcaacattgcctttcttgggctcgtgttgaatcagctacagcaacgggcatcattacaacaagtcatgctattaatcagtatctttttggccgttcgttttttgctacaattgtgcggcggctggtttaacaagcgcgccgaggatcatgaaactgcagttaaacggcgactcgatcgcgctgtgaccgaaaagctattaactgttagctacagcacgctccaagatccagacatgcgcaaggcatatgctggagctcaggctgggcaatccttcagtggtggcttatcgacacttatgaaagaagggttgcaggacttcttttcgcttataatcgctgttggttttgggattgcgacacttgttagcctcatgaaaccaatggcagcctccagtgcgtggctcaatgatgatcgttatcccttgatgattttggctttgttgatcttaccaattgtcgttggcagttggagcattaaacacagtaatcgcattcaacaaggggttattcaaaaaatcattccaagtaatcgaaggttcacctattttttcaatttcactgaaaatatggacaatcatcaggttgtccgcctttaccgtgcaagtgacctcattatgcatcgagaaacaaacagcaccatggcatcacttcaacaaatttgggatggcgactggcaaatggccaaatacggtcactggccaaatctcgctatcgccgttgctgtcatcggtctctatatcttagtcggcgccaaagccctcctcggtagccttgcaatcggcagcgtcatgatcgcggttgggtattttcaacaacttatgaccgcggcctacgaatttcttcagcaagttggcatgtatgtgaatatggttgactacctccaattctatgtcgattttctggccctgcctgatcacgaaaagtccggctcgctgcctgtcgagaagcgcaacgacaacgaatttgccatccagtttcatgatgtgagctttaaatacccaagcagcgatgagtgggcgctgcggcacgtcaatctcacgctgaatattggcgaacgccttgccttggtcggccgaaacggcagtggtaaaacgaccctcatcaaactgcttgtgcgcctgttcaaaccaactgaaggcacgatcacccttaacgatatcgacattcaaaaatacgatgaagacgaatatcgcagcctacttggggttgtttttcaggattttcggcttttcgcttatagcatcgcggaaaatgttgcggcaacgacccagcctgatcgtgaccgcgtttggcaagcactaactgttgcggatgtggccgatcgggttaagcgaatgcctgaaacaatcgataccccaattacaactgcgttaagtgacgatggtgtggatgtctctggcggcgaagcccaaaaaatcgccatcgcccgcgcgtggtacaaaaacgcgccgatcatgattctggatgaaccgaccgccgcacttgatcccatctccgagtatgaaatttatcaacggtttgacgagctcattgaagggaaaactgccatctatgtgtcacatcgcatgagctcaacccgtttttcccaacggattgtggtgcttgaccatggtcaactcgtccaagatggtacgcatgccagtctcatggctaaatccggcatttaccgcgatttattcaatgcgcaagcgcaatactatacagaggacagaataaaagctgcacgtaaaaaagtggccacatccgttgcacccgtggcaaattaacaaaaacgttttgggttgacttaccacgaataaactttaccaactgttgcgacattatctctgaccatcaaaaaacactcgaccacaactagtcgagtgtttttcattgcctttcaattaaccaaccaagctgccattctctaagttctcagagacttccagcaaagtgattttcttgccgtctaaactttcagccgacaacaacatgccttcagacatttcgccttttagcttgcgcggcttcaagttgaccacagccatgacctttttaccttttagcttttcgtaatctgggtaaaattcccgaatgccggaaagaatttgccgtgtgccttcatcgccagcatcgagcgtgaacttcaacagtttgtcagcacccttaaccggttcgacattcaaaatttctgcgacccgaatttcgcttttatcgaattgtttgaactcgatttctgacttccgcgttttttcatcgacggttgcttttgcggtgccgggggtcatcttgctcttgatatatgccacttcttcttccgtatcaagacgcgggaagattggcgtgccttgttcaactactttgacaccagctggcaaagcgccccattggacaagcttgtggtcgtcattttcatgatccaagccaagctgaccgaagatttgcaacggtgcatgggtcatcactggttgaatcagtagagcaatcagacgcaggctttcggccaagtgagccatcacagcatcaagctgatcttttttggcaggatctttggccagattccacggttccgtttcgtcgatatacttgttcgcccgagaaacaattttccagacttgatccaaagcatcggagaaacgcaactcgtccatcaatttgtgatattgtgccaaagccgcctgtgccacatcgccaagatcttgatcaaacggcgttacatccggtttaaaggctggcaaaataccgtcttcatacttgttaatcatggcaatagtccgattcaacagattgccgaggtcattggccaagtcgtaattgattcggtcaataaagtcttctggtgtgaaaataccatcattaccaaacggaatggcgcgcatcaagtaataccgcaaggcatccaagccataccgttcaacaatcatgtccggataaatggcattgcctttcgacttactcattttgccatctttcatgactagccagccatgggcgtaaattttctttggcaacggcaagccgagtgccattaaaataattggccaatagataatgtggaaacgaacaatctccttaccaatcaattggacattggctggccagtatttgtcaaacaaagcgtgatcattactgccatagcctagggcggtaatatagttcagcaacgcatcaacccacacgtaaacaacgtgcttcggatcggatggaatctggacaccccaattgaagctcgtccggctcatcgccagatcttccagacccggtttgataaagttattgatcatttcagttttgcgtgaagccggttgaacaaaatccggatgctcgtcataatacttcaacaagcgatcggtgtacttgctcatcttgaagaagtagcttggttcgtgaaccagctgcacttcatgaccagacggcgctttcccgccggtcacgttgccgtcttgatcgcgataaacttccgacagttgagattccgtgaagtattcctcgtcttcaacggagtaccagccagtgtattcgcctaaatagacgtccccttgtttgatgagacgttccacaatcgtttgaacggcttcgacatgttccttgtcagtggtccggataaacttgtcattggtgatttcaagcattttccaaagttgcttgatttgggtcgccatgccatcaacataagcttgtggcgtcacccctaacttatcagccttttgctcgattttcaggccatgttcgtcggtcccagttaggaagaaaacgtcgtagcccatgagccgcttataccgtgcgagcacgtctgctgcaatggtggtgtaggcgttgccgatatgtagtttgccagatgggtaataaattggtgttgttacgtaaaaagttggtttgcttgccatgcaagggcctcccgtacattagttcagaatgagtctagtatagcataggaaacagcggggctgtatagttgcccacagctaatcatttgctgctaaccagtgatccaaaacactgataaattcatcatgttggtcaagcagcgccaaatgccgactgttggcgaagagatgccatttggcgttaggaatatgatcgacaactgttttcgcaataagcggcgtgcagaggtcatcagtcccattggtcaccaaaaccggaacgtgaatgtttttgagctgatcggttacatcgaagtcgctaatcgtcccattttcagtaaattcattggggccttcagcaattaaactggcgcgtttgccgttagttggccggcgtagcggttcaggtgagttttcgtctggatcatcccagcagtacttttccatgtagcgatcattggccgccagatatttcacattcgtaaagtcgccagttcgttctgcttctgcgatggcttcgcgatcttcataactcaggtatttgatcaggcgatgttgttcctgaatccacaacttaatagatgacggcgagccgtcaatcatcacactcttgataccttgaggatcgaagctggttaaataatacatttccagcataccgccccatgattgaccaagcatgtgaagctcatcgaggtgcaggtactttcgtaaggcgatcaactcttctgcccaagtttctttaacataaaccgccggatcttctggcagtgacgacttcccgcagccgacttggtcgtacataatcagttgccggccggtttcggcatagtcgtccatgagttcaaaataattatgcgacgaccccggtccgccgtgaatcagtaacaacggcgccttatcagcactaggttcgccaacgattcggtaataagttttatattcatgaaacggcatgtagccttcttggattttcatagatgcaccagtctccttcttaaaaatgatgatccttaccgcgattgtactacgcattgatcatggtgtcagaaagaatcgaagcgcgatcgccaacccggtttctggatcggtggtcgcgcttcgaagatgatatgtttgctctcaatgctaacttagcgctgtgctgttatccgagccggcctctttgatcccaacttaatcagcatcaaaacagatctaattgttgtggggcaagacccggaaagtccagacccaacaaatcgatcaaactttgcgcattggctgcagcatcgtgaccaccattattgttgaagatgacggtaacatttttacttttcaaatgctgcgcgatgataccaaactgctgcagttcttcttggctgtaacgataattggttctttcagtcgttttggcgccggttcgaccccatgccggatttcggccatgcaagcgcatcatggttaaatcggcattcgttgcaattggcacaagcggcactgagccgctggtcgtctgcgcttcatcaacgatcacgtgaatgtcgccggctgcttgcaacagcgccatcgtgttggcacgataagccggcaaataccagctaggatggcgaaattcaatggcaacaggtaaatccggcagcaaacgatttagttgctgcaagtagcgtacattttctgcggtcacgccaaaatatggcggaaattggcacagcaccgcctgcaactgatggcttgcaaccagcggtgccaccatatcattaaatttggaaaagtcagcgactgtgtctgcactttcttcgtgtttcgtcatggttcgcgtcgctttaattatgaactgaaacccagatggcacttgggcctgccagtggcgaacctgttccacaggcttcaatccataaaacgtcgtgtccaactccagtacaggaaaatgctgagcgtaatccgaaaacgtactccgattgccgcgcgtcgctaattctggatgatcggctacactcgtcaaaccaacattaatcatcaatttcaccatccgcgatgcgaaaatcttctaaccgatcgccggtaaaataagatgcataatcatggcgttcgccattcagcgcatagtgcaacagcggctgtaaatctggtaccaagccgggattatccgctaacaaccaatcttttgaaaaagtcgctaaaatgccctcccgagtggctcgcggcatcaccaactcgtcttccgtgtggccaaagaaggcaaaaagttcggcccgcaactcaccatcaacatgccagaacacacgcccgccattgatcagatcatgcgggggaataataatgtgactttcttcctgcaattcacgtgaggcgcaagtagctggggtttcattaggcaggaatttcccacccaatgtattccacatgcctcgatatggtggattcgtccgattaattagcaaccagccgcttggggtttcgacagtgactaaggtatattttttgaccatgtttgctcctttgctttgggatcatcactagcaaaaaggcgccgaaatggcgtctcttttgaatctttgatgacaggcctttttttgcgaggatacgtcaaaccgcccagattagctgaccgtgaaagagcgctcgtaaaaggacctacttcatttttgcaaaggtatccttaatgataccggcagagtgaacatacttagcacgctcttcatctgtcaacttcaacgttggcgtcttgataacaccttgtttaccgatcatggctggatgaccgatagcaataccgaattctggatcgtaattagcgcatgggaagatgcgatgtgcatcactgatgatcgcctgtgtcatttcagtcgcgatggtggcgataccgtagctcgtataatgcttagcctgataaatcttccaaccgcctgcccgcgcatcatcggcaagctggtcgtaatcaaccttcgcatattcagcaatcggttcattattgacccgtactgttgaccaagcggtaaattgcgattcgccatgttcgcccatattgtaaccacgcacgtcagcaacattcacatgcaaggtatcggcaaccgcccgtcgcatccgataagtatccagcgaagtcccagtcccaataatttgagacttcggtaaatctaagagatattgccagtaactcgtgacagcatcacatggattggtgatatctagcaaaacgccatggaagccagacgccttcagttttggagcgacgtcatctagtgctacttttgaagtcttggtttctccaattcgatcaccatttgaaatggcgccaatattgccgaccgcggaaataaccacatcagcatctttcaaagcatcataatcgttgacaacaatgtcagtataagtgggcaagccgccaagcgcatccttcaagtcaaagctttcgccttcagcaagttcagcctttttatcaatcaagactaacttgtcagcaacccctttgctgacaagattaaaagccgtggtcacacctacgtgtccaataccaataataccaattgttcttgccatataaaaaatctccttttcaaaatgcgttcattggcgtgatttcttttttgaatcagccatcaagtgacgttcaatgcgctgatccggaatcgcccatagcagcaacatcaataagtctagtatgatcgtcaacggcggccaaagcaaagccaataacatcgcaacaagtgcaatcgcgactgaggccgctgctttccagttgtgccgctgccgatataagtctgctaatgccgatgttggtccattgacgcgaatcagggtttgtactaatagcacatagctgatattggccatcaagatcacaaacccataggccaattcagggccaaatgtccctacgtgtccttcgcctacccagctagtggcgaatggaaacattgacacaaccagcatgaagaaagagttcgcccacatcacccgccaatcgattcgttcgaccagttgaaacaagtgatgatgattattccagtaaacaatgagtgtcaaaaacgacactagataaatggcaaaaacaccgcgtagttgccataacgaagccaatgatccgctgtgcggcggttgcaattctaacaccagaatcgtcaggataatggcgataaccgcatctgtaaacgcctcaagtcgccctttattcatggcaatatcccctcacaaagttatttttggaagcttcgccttcacttacagaatttcccagatgatgagcaaaagctaagttgtgattgcttcagactaccagcttcgcaaatacgttcaccgcatccccctgcaccatatgcgcgccttccggcaaagcgatcttttcacggttcacagctacaatggtcgcctctggttgcgcatagccaatcaaccccgcaaatggataaaccacgaagcttgttcccaccacgatcagcaaatctgcagttgaaatggcttcgatcgccgcgctgacggtatcgggattgattggttcaccatacaacacaatgtctggtcgcaaaataccaccgtcagctgcatgaacatcacttttcagataggtctcgtagtcaaaatgcttgtgacaagtttgacaataaatgcgataaaggttgccatgaaattcaacaacatgctctgcgccggccttacgatcgaggccgtcaacattctgcgtaacaatcgtacctttttgattggtgatggttgccattttctcgtgaataacgttcggtttagccgctggaaagtacatattattgacaacaaacttatgaaaatcttcatgatgtgcttgtaaattatcaatagacagtgcatattccggatcgacttgatcggcgtatagtccgcccttggaacgataatccggaatccctgatgctgttgagacccctgccccagtcatgaatgtcacatgcttcgcctgctgaattgcagtttgcagatcaaacatatatggtccctccttaaacgcgatcaccggctcagaaacctgcacataaagacctcaagcctaaaaggccgctgatgctccggtttctaaacgggttcgttcacgcgcttatctcttagcagatatttttcaatgatgaaaatacgcaatcaaaccgccaatccttagcatgacgcatctttaatatttcaagttgcgtttaaatggttcacatgcgctattaatttaaatcaaaaaaggtgtaacataacagtagaaatactttcagaaaggagtcttgatcatgaagtcatttcggtggtcacacgttattagttatctgatcatggtcatcgtccttgttttctttgccttcgtcctttatcaggtcatcatgctcggtgttcattccgtttccaatagtttcttcatcaactttggccggcattaacgaatcgtgtagtcgagccgatactgcgtcagaatgtcattcagcgattgttgatacaactgctgaaaggcttctggcgttgtttctttttctggcaagggcagtacaaacgcattttgctcatcgctgcgtcccatggcaacatatgcgggttccttggtctcgcgatcacggtagccactgtgtttgatcatgaaaacctgatccaaggtaaggcgtaattgccgatgcgacagaacaggcgtcaacgttgcaaattcagcatcgttggtcggttgatagcctagccgttcaatcacggtatcaaatcgcgccagcaggtgaacaacggcgcgtcgtaatccaaatggggaatcaagcttctgcgcatccagcaagtcgtaaagttcgcgtgcaagcggcaaagcttgtggataggcatttgctaattctgctggcaactcaccatttaaaaaccccaacaaatcaagcaacgatagcactcgataaataaccaactggtcatcggcttctgctggcacattttgtttgaagccggcgagcacttgcgccaccgctgcgtctgtcaaaaggttgtgatcgcgttgccaggccaccacgagcatatgcaccgcagcattgtatagcgaggtgctcgtggcataaagttgatcgtctacctgcggatcaccgctcaataaatggaattgaagttgcggataacctttcatctggaacaacaggtgtagtaactcatgacttaaggtgtaatcgacattggtcgtgtccgtcactgctaccactagcgtaccatcttttttcaattgctgatggctttgatcgtgcgttaagacgccgctcgccttcccgctaatgtcgacttctaggggatgatcatagtgttccttgacttcatttagtaatgtttcaacgtcttcctgcatcgtattgcactccttaaacgcgatcacagccgcagaaacctgcacataaggacctcaggcgtaaatgacccaaacccagccgtttacgcctgaggccgcttatgctccggtttctaaccgcggccgctcacgctctgtcttaaacacggttgctgacccagaaaccgggccagctcacgctctgtgataaattggctttaattatttttatcctctatcattaaggtagcgataaaagggaggaaattcaaatgaaactatccgtaccacttatcaatggtcaacttgccgatcgctatggcaagcatgcaagcggcagtgacgttaaaaatggctatcccattacgagttttccttttacgattgaggatgcccctgccgaaactgtcagttttgcactttggttccttgactacgatgctgtaccggttggcggcctaccatggattcattggaatgcggccaatattcccgccgacagcacaacattcccagcaggcgccagtcataccaataaggtgccaatggtcgaaggcaagaacgccaccgctggccacctcgtcggcaacaccgacccattcacacaggctggttatgtcggcccgcaaccaccagataaagatcacgattataccttaatcgtctttgcattggatacgaaattgccactgcaagctggcttttggctaaatgaagctcggcacgcgatgaagggtcacatattagcacaagcagaaattgatctgccttcgcgcgtttaaccgacaaagatgaaaaacccctgctgaccagcgtcagcaggggttttttcattttgacaccagcttcttaaactgtcagctaccatcgcctgtattcagccataaggcaccagcgccggctgcagctaaaacgccgacaccaataataccgactaacgcaaacttaaaaatggcaaagccgccaattgcaaatagtatcagactgataaagggatgacggaggatcgcacccagtaacttaatcaccaaaaacaaaatgatgatcaccgccaccactgcaccaatcaaaattgcgccagttaaggtatgaccattgccactaccttctgtcgttgttaaaattgccggaatcatcacaaactgtcaccccttgcttaaaccgctaaaaattatttgatcaggctctgaatccattgagcgataccattaaagaaactcacgatgccatcccagattttttgcaggaaattccgattttcttcagtgttcaggctcttattgagtttatcaaacaagcctttagcagaattctgaatggaatcggccagcttccctgcctgtgctttaaagtcattgttctttagtgagccggctttttgaacgttcactagtaagttgatgatcaattgtcgctgattgttgttaataatcgttgttaaattattctgtttaagctgactgtctacgatgttaccgatctgattttgggacaaagtctgctgcccgttgttactttgactggccatttgctgtttcgcacccgccacggcattattgagctgcttgtcagaataaccatctttgtccttattcgcttgggtgatcgaactcaaggtgttgacttcctgctgagcagcattgatttgctggttattcaaattttcgccattttgagcaaaagccgcataaacccctgccaaggcacctgaaccatcaattctaaccgcgctggtaatgtagaggttggcattgctaaccccagcggttaatgccgcattacgatattgatcagcggtgatggtggtgatgttattggtgccattataagggacgattttgacattaatgcccccattatcagtcttttgaaccaacgcgctagaccagacgcctgagctttcagtaaaagtactacctgaaggattgaggtacttcaccagtgtggccccattcacggtcagttgactggcattgttgaccccggcagcattttgtaaagtgctcagggtgccgcttttttgatcagcagtcagtgaggaaccaattgttgccactggttgtgaccaagtatcggctcgcaccacatgcggtgctgcggttagcaaggccaagcctgcaacggccagacctagccatttcataaattttttcatgagtaaaatccatccttttaaatgcgttctccagcccagaaacctccgcatagggacctcaagcacaatgaccatgacccagtcatcgcacttgagcgcacttatgctccggcttctaaccgggctggctcacgctctcctttagattggtaccttcattatcgctgcttcagtgcaccccgtcagcatgtttaccagacttttaagcaatgattaactaatgctcacgctgtgtcaccgcacgcgtgttcaaatgatcgtacagcgcgccttctcgcaagccaaactgtgagaaggtgagacgatccgagtctagataacgaatcatcgagataaccggcatcaaaccgcccacgataatatcagcgcgaaactttgacagccccggaattgactcccgcgtggccaaatctgcaccaagaatttccttaaaaatcgcattggcctgctttgtcggcattcgatagccgtgaatcgcctcaaaatcagccattttttccttacgtcgttcgattttcgccaacgtccgattgcttccgccaagcgcgataatcggcaaattctgtgctcgccgcagccaccagatgctgttaaaagtctcatgaataaacgtacttaaggcaaaatactccggcgccgaaatcacatccggattcaaaaaccgttcggacaggttgaccgaaccaaaaggaatcgataccagatgttgcaacttccgattttgaaccagaatcaattcggttgaggcaccgcctgtgtccataattaaggcgttttgaatcggcaaggtgttgatgacgcctaaaaagtcatactcggcttcacgcgttcccggaatcacattgatgatcaaccccgcctcgttcttcacccgtttgaggaattctttttgattcttggcttggcggacagcagctgttgcaaccgcctttaaatcaatatcagcatacttattcagctccgtcttaaacccctgcaaggctttcagggtgcgatccattgctgcgggctgcaaaacgcgatctggccccatgtcctcagacaatcgcaccatttctttgagccgtttgatcggcttgacaacctcttgctcgatttcccagatcgtcatccgagctgagttactgccaagatcaattactgcaaaatgatgcgtcatgcgtcatcgtcctccttgggtgcggttatcggaataaaagtatgcgttgcatgcaagtcttcaggcgcatcatcaacttcctcacgtcgcaatgcttcacccatggcttcagcatgttcaatgaagtatgcctgtgcattgagttttgtaaccccgcgtaattgagcacgaacccacgtactgtccggttgtaaaattcgcgttttaacgttatctgcccacatgatactgaaaattttgatgatgcgttcgcgaatatcgtcctgcaaaatcgggaacagcagctcaactcggcggctcagattgcggttcatcaagtcagcagatgaaaggtaaacattttcctgcccatccgcataaaagtagtaaattcggctgtgttccagcaactgtccgacaatcgaatgtactgtgatattgtctgaaactccgggaataccaaccttcaagttgcagatcccacgaataaggagatgtatctcgacaccggcattggaagcttcatagagcttctcgatcatggccgtatcagatagcgagttcatcttcatctggatcaaggccttgcgccccgccttagcagcagtaatttcttcatcaattcgatccatcagatagtctctgatgcccagtggtgcaatgaccagcttgtgaaaatacggtggttccgaaaagccggaaagcatgttgaaaatattagacgcatcttcgccaatttcgttgttgcaagtgaacaagcccatgtcggtataaagccgcgccgtcacatcgttgtaatttccggtcgccatgtgcatatagcgcttgatgccttcctcttcgcgacgaacaaccaacgccaacttacaatgtgtcttcaaaccgaccaaaccataaatcacgtggcaaccggcatgttccaattcttgcgcccagtgaacattattctcttcatcaaaccgcgccttcaattccaccaataccgtgacctgcttgccattttctgcagcttttttcaggtaacggatgatcggcgatttgcttgaaacccgatacagcgtcatttttaccgcaagcacttgtggatctaatgccgcttcgcgaataaagtcaacaactggctgaaagctgtcataagggtgctgcatgaagacatcgcgatccttaatgacatcaaaaatcgactctttcttgaaatccggatccatgtacggtgtgaatggcttgaatagcaaatctttatgatcgtgcacttgtttgaccaatttgctgagaaaattgagatcaatcggaccatgaatttcataaacgtcttcatccttcacattcatagccttgatgagacgtttgcgcaaatgcttgctcataccagcttcaatctcaagccgcatcactttcccgcgttgacgctttttcaactgggattgaatctccttcatcaaatcagatgcatcctcttcggccacatccatgtccatgtcacgggtaacccgaaatgtagccgtttctttgatgtcagcaccaacaaacagctcactgacaaacatccgcacgacttcttcaagcaaaataaagacattgtcgccgcctggcagccgcaaaacccgcggaaaaacatcaggcacctgtaccatcgcaaacgaccgtgacttatcgcctttatcatcaggccgaaccagccgaatggccaagttcagactattattgccaagaaatgggaacggccgcgtcggatcaactcccatcggggttaaaacgggatacagttcataatggaaataatctgagacaaaatcgtgctgtttctccgtcaattctgatgcatgtagcagttgaatatcgacagcactcatttttggcaacagcgaacgaaccaatgttgtgtattgtttctccaccattgcgtgggcggtttcggaaattgcgtctaactgctcttgcggtttcaatcctgctgcatccggctgatcataattaactgtgaccatttttttcagcgacgcaacgcgaatattgaaaaactcatcaagattgctttgcgtaatacccaggaaacgtacccgttctagcaacgggttattcttatcccgggcttcttccagtacccgatcgttgaatgccagccaactgagttcacggttattaaaataacgcggctttgaaaaatctagtttcttcataaaatgtttcttcctttcagctcaagccctagcccgaatacctcagagaaaaactttcctttgcgtgctaatgtccagcgttcaagttcaatatcatcatcggctctggccgttaacagcacttcatttggtttgacagaaacccgtaattgctgaatcttctgttggcgagatgcgtctagactatctgcaacgcgtagcaaggcggataacttagccacaactaagcgattttcggtcgacattgttggaaagttctttaagtccgattgcggtgtaatggagctgtgaaaccgtgtaatcgttgccaccatggttacttcaagatcattgagccccataatttcagatgctttgatgatgtaattagaatgtgcgtaatgtttgtgtgtttcaatgtaactaccaatatcactaaccgttgcggcgacttcaagcaaaagacgctcgcgtttgcccatgccgtgcaactttttcaatcgatcaaacagctgtaaggcaaccgtccgtgtggcttgcatatgggcttcatcaacttggtagcgttctgccaaattattcgcactgataacaatttcttcatttggatcaaagcccagctttttaaagccgccttcatgtgctgcattgacttcaataccatcaatggctttaagatctgagatccaaatagattgactgttgagcgtttcaaccaaccgatacaccagcaaaactgtcggcaaaaccagtgatgtttggtcagaagtcaaatcataggtatctgcaaggtactggtcagaagcctttgtcacttcatcgtataataaatcaaaccctggccgatcagtttctacctgatgcttgccttccggaatgatattttgaaaaatcgacagattactacccattaaaatcatattggtgtactcaacaccttgtggcaacagccgcataaagtcgagcaagcgactgtcgatatagtcgcgcatcacttcaacataatttgtcaccgagcgttggacatcactcatgatttcatacactcgcaaagggccaagtgacagattacgcgagaagccaaacacgccattgctgaaggtagtcaactcaactgaccctgaactgatatcaatcagcaccgtgcctttttgcgtaatcgatttaaactgcggaaacttcaccatgatcgcttgggtacgaaaaaaggcttcttctgatagtgaggtagttttaatgagccagccagttcgcgtataaagctgatcacgcacaaactcggcattatcagcttcggcccaactggtacttgcaaatacattaacagtcggtacgccatagtctttaaaaatttgattgatggcatcaaacgcttgtacgatcgcatcaacagtatcgggcaaaatttcatgttctgcataaaaatcatccccaatggcaactggatatctaccgcgttcaattgttttcagcgtccgcagatttgtgatgctaaaaacgattgcttgtgcaccgatcatcacaaacccttgtatattatttgccattctcgttccacccatttcttttcgtttgctacctgactgtcatcatgctctaatgccatgatagcacggtaaacactgcctgcatggctttttagacaagccttattactgacaatcggtctatctacctttagtttaccaaaaatcggcatcaatctttactgaatgtgctataagtagcgctttcttcaacatttggtccgaccaatggcagactcgactgctggctagtcagtcattggccaataccacagacctaataaccatcacaaaagcatgcgatagcctcaaattagctcgtccttgagggtgctttctcacgcaatcatcactgcttttgtgataatcttaaagcatcatggaacaattctgaaaggatgctcattatgaaaatgattgatctaggccgttctggtctgcacgcttctgccattgcgttaggtgttatgcgtttgccgaatctcgatcggccgcgagcaaccgaactacttgatgctgcttatgacgtcggcattaacttttttgacaatgctgatgtttacagcaatggtaaagctgaacagctttttggcgatgcgttgaagaaggccagctttacacgtgatcaagtcctgattcagactaaggtcggtatcgtcaatgatcgaaaagcgacccatcgctatgatttctccaaagagcatatcgtggatgctgtcaatggcagtcttaaacgccttggtaccgatcatgttgacagcttgctattgcatcgacctgacccgctcatggaaccagaagatgttgctgaagcctttctgcaattgcaaaatgaaggtaaagttcggcagttcggggtttccaacttcaatcctgctcagattgaactgttccaacaggcggtgccgcaacgattgatcatcaatcaattgcagttttccctgatgcacacaggcatgattgatgccggcatgcatacaaacatggcagatgcccgttccattgatcatgatggcggtcttctcccatacagtcagcagcatcatatggcaattcaggcgtggagtcctttccaatatggcttctttgaaggtgtcttcatcgacaacgataaattccctgaattaaatgccttacttcaaaagctggccgatcaatataccaccaatcccaacgcaattgctgctgcctggctcttgcgtgtaccagctgatgtgcaagtcatcgccggaaccaccaaacccgctcgcattcgcgccatcgccgaagccggcgacattgctttgacccggcaagaatggtatgacctctacttcgccgccggaaacgacctgccataatcagacagagcgttcaatggcgcggttagaaaccgacgcataagcggcctcaagtgcattgaccgggctttggtcagtctgcttgaggtccttacacgcaggtttctgcgactgcaaacgcgtttagatagagcatgaaccaacacatttttaaaaggaaaatcctatggaaaaacgactcgactacattacagatctcatggcacttggtccaaccgccaatgcaaggaccattcagcgtcgccaaactgcccatcgactcgcaattgctgaggcatggcaggtaaaacccggcgaaaaaattctggaaatcggctgtgggcaaggcgacctgagcgccgttttggctgatcaggtcggctcatccgggcatgtgactggcattgacatcgcctcacctgactacggcgccccgctgacgcttggccaagcatggaaccacttgcttgcgggaccgcttggtgatcgcttaacggttcatttcaacactaatctttcggatgatcttgggcccatcgccgatcagcattttgaccgggttgtcctggcacatagtctttggtactttgcttccgccaacgccctcgccttattattcaaaaacatggcagctgtctgtgatcacgttgatgtcgccgagtggtcaatgcagccaactgcgctggatcaaattgggcatctgcaggcggctatgattcaaggcttgctgtatgccattgctccaagtgatgtcgccaacattcgcacgttgatcacgccggacactttggcacaaatcgcacatgataacacatggacctacaccgctagcaccatcgtcgaagaccctactttagatgatgcccactgggagattgcaacaaccaatgcgcttttgaccgaactcaagctcagcaccgatttgcgtgatcgtgtgaaaccattgctcgaggctatgagccataacggtacggcaagtttagcaacctttacgggccgcatcacattttaaccaaaatggaggtcatcagacgttgattgaatttacccctgccacagccagtgatttaccaaaaattgtcgccatttacaatgaaactatcccgacccatcaagcaaccgctgacttgcagccgcaaacagtcgctgagaaacaagcttggtttgcggctcacaataaccattttcccgcttggatgattcaagttgaccacaaaatcgttggctggctgacactgtcggcttatagtgaccgctcagcttatgaccaaactgccgaaatcagtttataccttgatgtggccgcccgcggtcaccacgttggcagcgcggcattggcctttgttgaccgcgaagcacccaagcacgacttaaccaccgttctcgcccgaatttttgggcataaccaagccagtcgcaacttgttcaccaaattcggttatgaccactggggccatttgccagccatcgctatcctgccagaaggagaagcggatttagaagtctatggcaaacactttaaaagcagagcgtgaactggcgtgcttagaaaccggagcataagcgaccacaagtgcattggccgggttttggccagtgtgcttgtggtccttatgtgcaggtttctgcgccagtgaacgcgtttaaaaaccggagccataagtggccgcaagtgcattgaccgggttttgccagtgtgcttgtggtccttatgtgcaggtttctgcgccagtgaacgcgtttaaaagagcgtgaacgcgtaaaaagcgtttgactgatgctaacgggctgacccgttggcgatcaatcaaacgcttttttaatcttggtgcccagccaattcatcttcctgctgtctaatgcgccgcatcgtccgaacatacgagctgactagtaccagcacactgccgaaccacgccagcgggttggccgccgatgcaccagcaaagccgaatggcacaacgaggaagatcgccgcaaacgcccgcatccccaattcgaagaatcccgcaaccgttggcaccaacgtctggccaagaccttgcaacaaattacgaatcgtgaaaagaatcgccaacaaccagtacatgctggcattgaagtggaaataagtctgggctaaggccgtcacagctggttgattcggcccgagaaacaaattcactaatggtttgctgaaaagaataataaccacacccatcactgccgataagccgacgttcaccatcaaggtttgataaactccacgacggattcgcccatattccttcgcacccagattctgcgcagcaaacgtcgccattgccaccccaaaagaggctgacggcaaggtcgctaactggtcaattcgtccagccgccgtatacgcagcaaccgcattggtgcctaatgtattcaacatcacctgcaaaatgacagcaccaattgcgataatcgacatctgaaaccccatcggaagcccaacttttaaatgctgaacaatatcgtgccaatcaaagcgcaaatcacgacgccgaatcattagaagcggtatccgcatgcgaatgtaaatccaacagagcaacgccgcgatcacttgcgcgctaaccgttgcatagccggcaccagccacccccgaatgaaacccgagaatgaaccaaaagtccaatacgatattaataatggtcgcaatgatcaagaagaacagcggtgttcttgaatcgcccagtgcgcgcagcatattgcttaacaagttaaaactcattgatgcaataatgccgaaatagataacccgcacaaaggcaatcgaaccatccatgatatccggtggtgtctgcatcacggtcaataatggtcgtgtcatcgtgacggctgctacggtgagaatcagtgaaatcccaaccgtgatccaaatgctcgtaccgaaactgcgtcgcacacggcgataatcatgagcaccataggcctgtgctgtcaaaatagaaagtccagccgtggtcccttgcgcaaatccaataatcaaaaaaacaatgctggatgttgccccaactgccgccaacgcatccttaccgatcgtccgcccaacaatcaacgcatccataaaactataaagctgttgaaaaagattgccaatcagtaatggaatcgtgaacagcacgattaatttcaatggcttaccgatggtcaaattccgcattaacaaatcctccaaaaatgatcgtgtgctcacccaatcaggatcgcacttttcaacaacgggattgcacacgtaaactacctgtccgtcatcggatatcactgataagcgatatgacatgcgctcgttcccgttcacaaaagactaattcaacaaccatagcacaaaaaaccaggcagcgactcgctgtctggtaattgaaatatatttgcaatcaaacatcggcaccaccgccgccggaactgccgccgccccagctggaaccgccaccggagccgcctccgaaaccaccgccgaagccgcctccgccgccacggcggccagaagatagcagcgcgtccagaataacccagagccaaaagctactgtcacctcgaccacggcgaccaccacgaccaccgccgccgcgactaccaaagatgatggccacaacgacgacagcgataaagatgaaaacaattttcgtcaaaaagttgccgccgctgtcttgacttgagttgcgatattgattcatcgtctcatcagaaaccgtgttttgatctttaggaaacttgtatttcttatcgatgactgtcgcaaccgcattgaaaaccttgcgaatggcctgattcagttctttaggatcatgtgacttgatgtccttcagattgtcattcaagattcgcccagccagcgcatcaggcaaatcaccttccaaaccataaccaacttcaatgcgcatgttctgcttgccgccattattcgcataaagcaaaagcaccccgttatcggtacctttcttgccaattccccatttctggaaaagatccggtgcatagtctgacaaagggtcgccatgggtcgactttaaagctgctacggcaatttgcggctgttgtttagtgccttggtaatactgattcttactgtcgatcagttgcttggtactttcatcaagcacactgtcttgatctagatagtaatgctcggtgggccgtgccggcagatcttcggctgccgccactggctgcgcggcgccagtgaacaacaacaaacccgtcagcgcggcaacaaaccacgctaaatgcctgcgcatggtgccacctacttcccggaactagagctgttcgttgaaaaatcaacgcttggaaccgtttgggcagccggtgttgctttgaaggtgtccttcttccctaagcccatcatgctagcaaaaatattcttcgggaaggtcacaacactctggttataatcacgaacctgatcaatatatcgcttacgttcaaccgagattcgattttcactaccttcaagctgcgtcatcaaggtgttcacctgattgctgctttgcagtgtcgggtaattctctttaatcacgttgatcaaagtacccacactcttgttcaactgatcatcagccttagctttgtcagttgtcgaacttgcattagcatacgacttgcgggcttcagcaatgtcaccaaaaactttctgctcttggcccatgttgcccttaaccgcattaactaagttaggcaccaagtcagcccgtcgctgcatgacgttttcaacctggccccattgcgcttcaacggcctgattctgcttagctaacgagttgtaggtgccgattccgaagatcaggcagatagcaacaatcacaccaaggacaatacttgtgaccgcaactggacttaatcgtttcgttttcattgatatgaattcccctctaatgcgttcacaattgcccaccttttcacggaaaaagccgtcagaaaacaacggtatttccgtgaaaaggcaggctacaactgctcacgcttatcatcaatttcctgcttataccatcattctaccatgacgacggttttcgacatccggcttaagacggaacttgactatttaaagtagttgaatccgatcgcatcccgaacttcctgaagcgtttgattagccaccacattggctttagccgaaccttgcttgagcatatcagcaaccgcccccatatccttggcatagtgctcccgccgagtgcggataggttcaagcactgcctccatgacatcaatcaggtagcgcttgatcttcacgtcccctaagccgccatgttggtattgggctttcaactcagcaacttgctgcttatcaggatcgaaaatatcaagataggtaaagacaacattaccttccaccttaccggggtcttcaacgtgaatatggcccggatcggtatacattgacataatcttctgcttaacggtatcagcgtcgtccgccaaatagatcccgttatttaagctcttgctcattttggcattgccatcaatccctggcagccggccaagaccctttggtggaaaatagccttcgggttcaaccaacacatctttgtgataagtccgattgaacgtgcgcacaatctcacgagtctgctccagcattggctcctgatcgtcacccacgggcaccgttgtcgccttaaacgccgtaatgtcagccgcctgactaacgggataaatgaagaaacctgctggaacgctatcaccaaaggctttttgtttaatttcagctttcacggttggattacgttccagccggttcaccgtcaccaaatccaagtagtaagccgttaattcaaacaaagccggaatctggctttgtaccagaatcgtcgtcttgtctgggtcaatcccaaccgccagataatccaaggccacttccagcaaagagtggcgaattttttctggatcgttggcgttgtccgtcaatgcctgcgtatcggcaatcataacaaacggttcgtattctccagagttctgcagttccacacgatttttcagtgaaccaatgtagtgaccaatatgtaaccgtcctgttggtcgatcacctgttaaaatgattttctttgccatacttgtttcctccttatattgtgagcgcgagccagcgtgggtgaaaccggagtgtaagcggccttgggcgtgatggtcgcactttgaccattgcgaccaaggtccttatgcgcaggtttctgcgactgtgagcgcgttatcgtaaaaaaagcgtcctatgtcataacaacataggacgcaagcgcgcggtaccacctaacttgtccgccttgcggacctctcttggcttaaggcgcaccccaccgaacataacgcaaacgacccaactttgcctaccatggtcatcgacgtcacagcattgccgactctctggagaccacttagataagctactcatcgtttgtgtgaatatgggtttaggttagctaaattcgctagtgatgtcaatgcaaggttacatctgtgacttatcaatttgctcagttttgttccaactaatgacatcaattattcgatgcggtagcaatgacaaatggcatggtaagcgcacctttaattcaatcaaatcagccacgtttctgcccatattaagcctttataatgtcaatcgggtccttacggctaatcagccgaatcggccataagctagcaaaaatggtcaccccgaaactcagagcaagattagtgataaaagctgtcaaaatgatggctatgaagtgaactcccaaacgcagcgccattatcgttgccgcaaccacaattaaaagcgcagcaccaccaaaacaatagcatccgtatttcatggcattccagaaaagaatgcgccgaacatctttagttgtgaaaccaaccgcttttaaaatcccaacttcccgcaatcgctgtcgattgttcatactgaaaagtatggtcaacgcaatcatacttgccatgatgaataaaagtgcaatctgccgcgtgccgttcttcgctttctgcacagtagcattcagtgacgccacattctgtgcaactgaggaaacactataaaaaccggaacttgatttgatagttttagtcattgaaaccatatcgttataacttttagcttccaatctgagcgcgctatacccaaaaggctgttgcttgaagccttgaaaaatctgatctgacgttgtatttgctcgaatagcactgtgcagcaaagtcgtcatgctagcatcatccatgaaaaaagcgttaccttgctctgacagatcataaggatagtttgaggcatagacgccagtgatggttgctgccaatggctgctgaacatatatattgccatctatcgcgaccttctttttattattggttggcagctcactttctgaaagatattgtgcatatggaatatagacttcaaatgctacttgtttacccatcgcagattttgtcgatatgtgatttttttcaagaaagtcttggctgactatgaagtttgttcccactttagctggatgtccatttgcatacaaatattttttggtcaaatcactcttataaattggctggattgaaaaggtttcatcgacatgataactttttccgcctaatgaaaaattggaccctttgggaaccggctgtctaacattttcttttgtcaggccatatgaaagaaaggtgtagtaaggctgtacagatgtaatccccggcattttcttgattttttggatctgtttaatcgtcaaatttcgaaatggatcgagatcctgatgactgcccgtaccaagggtgttattcgtgacaaaaagtgaattatccgttgcttgattgagttcgcgttgttgctgacttgccaaaatttgtggcacatttaaaactatgctggcaacggctaacatgaccgtaacaatgacaaggaagccattaggcagtttttttgctgattgatagttgtcatagacgagcgcttgcttattggacaaatctgatcgatatgtaacagcagatgctgtcggttggcctgccatgctttctggaattgcacgattgaaaagtttagtacccgactgaggcactaattgcttattattgatagtcaaaatttgatcagcatagtcttccggcagcgtttcatgtgacgcaacgatcacaatcgcctgttgttggtgagcaaagtccgctaattgttcataaaacatacgggcattttcactatctaaggaattggttggttcatcagctaaaataatccgtgcaccggaaatcaaagctcgaccaatagcaccgcgctgatcttcgccaccggataaatcctcgggcaacatgtgacgttggtcttcaagccccagcttatccaaaatggctgtcacgcgagctgctttctttgcttctggcaggttgctttttaaaagcggcactttgagattctcttcaagtgtcatcgtgtcgattaagttatgttgttgaaagacaaagccataatctttcagccgcacacgcgcttgtgtcgcatcatccagtgaccaaagattttgaccatcataaaccacttcgcctgcaattggccgcttcaataagccaagcacattcaataatgaagacttaccaatacctgactggccttgcaacaaataaaagtagccgcttttaaactcataagagacatcatgtaaaatctctcgatcaaacctgatcgtcatattcttcagcaataaattagatttcattagtgcccccttcaaatactcggttatcagttaataaaaaaaggactggcataaaacctaccagtccaacatataattaaaacaacataccaattaaggtcatatcatcccatatcaaaagagatactgcaaatcactctgcgcacttggataagcatagatcttgtttaaatcactcggcttttcaccagcatcaatggccgctgcgaaggtattgatcaagtcctcagccaagctggctaagacgacagcaccggcaagtcggccggtctttttgtcgacaatggtccaaacttgcgcgtcaggatcctggacccgattgtaagtgtaccagtgggtcatctcgttgtgtttgacggtgtactgatcaggcgctgcttcagcggcctctaatgaaaccccgactttggctaactccgttgggccaaagacgatagtcggaatggccgaatagctaatgggtgcttggtcgcctaaaatttggttggcaacataacggccttcgaagccggctaccggtgttaatttaggctgtggcttcaaattgacatcgccgattgcataaatcgtctcaactgcggtgcgaagatggtcgtcaaccggaataccacgcgtatcagccttaataccagcattggctagcccgagatcggcaacattggcgatacgacccatggcagtgattgccatgtcaacattcaaatcgaagttatcagcatgtagatgggtcatggtacctaagggcgtgattttagtcagttcgacgttaggatgaaaatgaatcccggtcttggcaagcaatggttttaaagcttcggtagcgactttggggaatgcccgtaacaaccgatcagaatgaccgatgatatgcacatccgcgccagccgctgcagcgatgttggccagttcgacactgacataaccggctccgatgaaggcaatgctggttggtaactgatcaaggtccagaaaatcccgactcgttttaagcagattggcccctggaatgtccggataacgaggcgtgtgcccagtcgcgatcacaatatgttcaccggtcacgttttgggagccaactttgacagcatgttcacctaaaagctgagcatgaccatacaacgtcgtgatcccagcatgagtcaggccattcaatgtgccagcaggtacgccggttgtgtaactgcgcttgaatgccattaaggatggccagtcaatcttcgccgtcccgctgatcccaaaaccattcatgcgcaaggcagcatttttaacttcgacaccgcgatacagcatttttttcggatcgcagccatagttgggacaggtgccgccccacaaatcgttttcaacgactaatactttttgctttgctgctaaaccgtaagctgctgctaagccgcctgggccgccaccaatcacaatcgttccataatcataagccatcacgatcactccttcgtctctgtgttctgatcgacaaatgcacttgcgagataagcgacaacactatgggtattgaccacaaacgcaccatgttcactattcacgcgcaacgcctcatgcgcatctaaaagcggcaacgcctcggccagcgtcaagttgccgccaaccgcatgccgggccgacacatccgctgcaaatggtgctaactgactgagcgtgacctgcagaccctgattggcttgcgctcccttgaacaaatccgccacgaaatcgttagccggattggtcgcaatttcttccggcgtatcaacctgcaagagtttgccaccgcgcatcacgccgatccgatcaccaagtttcatcgcttcagccatatcgtgggtcacaaaaatgacagtggtcttcaaggcacgatgcaaatgcagcagcatgtcctgaagctgagtgcgggaaatcggatctaatgctgagaacggttcgtccatcaagaccaccttaggccgtgatgctaaggcccgcaaaataccgatgcgttgctgctgccctccggataattcgcttggcatgcgattgcgatactcggctggcggcaaatcaactgttgtgagtaactcgtctgttgccgtccgaattttttggcgcgaccagcccttcatttcggggatcacggcaatgttttgcgccactgtcatggttggaaacaaggcgatctgctgcaggacataccccagatcccaccgcaagtcgcgcattttgtaactggtgagcggtttgtcggcaaattcgatgacgccgctcgttggatcaaccaaacgattgatcattttcagcgtcgtggttttgccgctgccggaggtgccgactagcacaaataactccccttgatcgaccttcaggctaagatcgttgaccacgggcttgccgtcatattcctttgtgacgtgttcaagactgatcaatgccatcagcgcacctccttcagcaagccatgctgaaccaaatagcggtgagccacagttgcggccttttcgttcttcacactcacggcataattcatggtctgcatctgtttttccgtaatttgaccagccaacttgttcaatgcagctacaagttgcgggtgtttttcggcaaaggccgttcgcattaatggtgcaccgcgataaatcggaaacaaccccttatcatcttgcaacgccaccagatgatattgccgcagttgcgcatcagtcgtatacccatcggtcaaattgatctgcccgcggtctaaagcttggtaacgcaaggaagcatccattgaatccaccttaaactgcaagccgtattttgattggatgcccttatacccatcttgccggtcaatgaactctaaatcaaatccggcgcgaatggatggtgcaattttgccaagatcgctaatggtatgcagatcataacgcttggcaaaactttccttaacgactaaagcataggtgttgttatacgccatcggtttgagatagctcaggccttgtttagcaagcagtttctttgcaagtggataattatctttaccagccgtcacctgttgttgctgagcggcagatggtttcgtcaaacttgccagaaccgtcccggaaaactcagggtatatgccgatcttatcggttctcaacgcattgtacaagaagctcgtctgtccaaagttcgatttcaacgtgaccccgacatcaggatcagctttttgaatgagttctttgtacatattgatcaaaatatccggttcactgcctagttttcccgcaatcgtgatagtttcctttggtgcggtcacataagtgtatacttggctgccaaccataccaaggacggcaaccgccacaaccccgacactgaccttccaactgactttttgcatgacatttaagagccacgaaaagacaatcgccaatagcgctgctgccaaagcacccattaaagttaacgccgcatcatttcgatcaatacctagcaaaatgaacgtgcctaagccaccggcgccgatcaaagctgccagcgtcgcggtaccaatgatcatgaccattgcagtccggacgcccgacaagataaccggtaaggcgatgggcaattcaactttgaacaacttccgcaatcgactcatgccaaacgcatcggctgcttcttcataggaaggatcaatatcgcgtaaaccgatatatgtattttgaaaaatcggcaataaagcatacaccactaaagcaataatcgctggcagtgtcccgatacccacaaacggaatcaacaaccctaacaaggccaacgaaggaatggtttgcaaaacaccagtcacttgcagcagcactgccgcggttttgtgatgcgtctggacccaaacggccaatggaatcgcaatcacaacggcgatcatcaaggcaattaaagatatttcgatatgttgccccaaggcactaagcaactcgccgtgccgttcagaaattgtccgccacaaatcagccatgttatgcctccaattgaatgtgatatgagtaagtgtaacacctagttttcacgtgcaacaagataaggtgtgttatattctggcaagttcatctttcttctgggagctggtgaactaacggtagttcgcgttaacttcgcaggcgcctgccactgtcttaaacgcttcaagaagcagtgccatgggcaatctagctcgaatactaggatagaaagcagagagttggcggagcggcgatgggctcagtggtgagattggtcttagcagagtggttttctccgcttagaccaagaccgagcttcgagacagcgcgccgggcttgcgcgttggctcgaagtcgtgcccaccactctagctgcgcggtcgccaccccgaatcgccgcggagtcaactcggacaataggatcaagtttaattagagtagaaccgagaaaagcttgacacatacaggcctgctcacgctctttacttttccaagtgcccagcgtacaattatcgacaccattttaaacaccgaaaggagcgccgtttctatggaaaatgcaacgaaggcagaagaacaggctcgggtcacggcggtcattgagaagctcaaggcaaggctagcggccattcatgaccagatcgaagcggcgcacaaagaaaccagccggattgaacgatcttacggtgaaaataccaaggtcaacgttaccgaagtcgatgaccaaatggaaaccaacgctgcggttcaacagcagaaagtcatggttgcccgcgccgtcgaaaatgaaaccattctcaaacacgaaggtaatcgtctcaccctgctagcggacaatccttattttggccgtatcgatattgacgaagatggcgatcccgacacgctttatatcggcactgccaccttcattgaccaagatggcgaattcttggtttatgattggcgcgcgccggtaagttctatttattacaacggtacccttggcgatgtcagctacgatacaccagcaggcgaacaacacgccactttgaaaaacaagcgtcagttccaaatcgaacacggccacatcaaaaccatgttcgacaccaatgaaaccgttggcgacgaaatccttcaatccgttttaggcgatcaatcagacgaatacatgaaaaatattgtcgcgaccattcagcgcgaacaaaacgacattattcgtgataccaccagcgacttgcttgtggttcaaggggtcgccggctccgggaaaaccagtgcggtcctgcaacgcattgcttacttgctatatcacagccgtagcgatctggatgctgaccaaatggtgcttttctcgcctaaccgcttgtttgccaattacatctcacaagttttgccgagcttaggcgaaaagaatatgcggcaggcaaccttgtttgaattcttggcaaaccgtttcaccggcttacatgttgaaacattatttgaacgttatgaacatgatgcagctggattgccgccagctgctgagcatatccgtcgctttaaagaagcgccgcgctatcttgaagctatctacgactatgctaagcaaccgaagcggacaccgcattttattgacgttgagttcaacggtgagactttcttctcagccgcaaccatcgcgaaaatttatcaagcccagccagcattgatgcagccagttgataagtttaccgccactaagaatgctttgatcaaacgtctgaatacccgaattcatatggaagccaaacgagactgggcgcagttgcgcgtttctgatctgtcacaaactgaattggaaaccttgaccgccgatcacgaattcgaaaccggtgaagatgaacagcgatttgtctcggaagctattgtctcaaaagcattttcaccaatctacgacgcactgtacaacgatcatttttacgatgtgttccaagactatcagcaattcatggcacaggtgaaaccacccgttgctccggctatctggcacacaatggtcaacgccttttcagacggaatcgaagcgcatcaattacgcttagaagatgccgccccgctgctttatcttcgtgatctcagcaccggcagcggtcaaaatagcctgattcagtatgttttcgttgatgagatgcaagacttcagtatggcgcagttgttgtacttgaaacacgcctttcctaaagccaagttgaccttattgggcgatgccaagcaagacgtgtttaccagtaattatcagcctagtgatttcattcatgaaatcgaggacgttttttccggctataaaattcgactcattacgttgaacaaaagctaccgatccacacaaccgattactaactttgccaaagctttattaccagaacacgaccatattcaggcgtttaaccgtgctggtgataaaccagaagtcttgacggtagcgcgcacggaagcacccgatgctttgtcaaaactggtgacgcaactgctggcaaccgataccaccgtggcgattctaaccaaagatgcccaaacggctgatcaactttacgccactctcaaacttgatgcaccagtcaccttgctatcggctaatgaccatagccttaaaaacggttgtgtcattttgccagtctatctcgcgaaaggtttagagtttgacgcagtcatcggttgggatatttctgcaaccacgtatcaaaatgaagccgaccgtgatattctctacacactttgctcccgagccttgcaccatctcacactcgttgctttggacgccccaagtccattgatcacggcactgcccgctgatctctacacacatgcaggggatgcctctgaggcgcgtgtctaatgccacccatgcatcatcaacaaacgcccgtgtcttcgctgacacgggcgtttgtttggcttctagaatcatgataaattatcaatgggacgatttaatcaattctgtttattaaaaatttggagggtttatttttgtttaatctactccgtaccttcatggccgtttacgaaacacgcagcttttccttggcagccacgcacttattcaccagccagccaactgtgtcacaccatattcatcagctggaacatcaactaaaaacaaccttatttgaacgaaacaaacgcagtgcgacgattcccacagcagctgctgatattttgtatacctttagtggcaacctgctggctgagtgggaaaaaacgcaggaagcgattcaaaatagtcaaaaggatgccattgttgacctgcatattggcgtatcgcaaagtgtcgccgctgttctattttcccgaatcgcagcggctttaaaaaaagcttttccctacttgcaatatgatgtcgccgtgctcaattccttgcaagttgtcaaacagctggaaggccaacatttagatttaggctttattgaacaacctttaaccttaaagggcgctatccgaacaaccctttgtacggatcaactgatcgctgcaggttggtctaccggcacttggattacccgcgaagaaggctctgggatgcgctattacaccaccgcttacctacaagcagctggtatttcgccgcaacacatgatgaccgtcaataacaatgccatgctgctggcattggtacaacaaggtgtcgggcaggcacttttgtcggatcaagtcgcactcggcaatgctccggcacaagcaattggcccgcaatttcaacggcatttttacttgctgcaaaacccaaccgccaattggccccacaaacaggccatgctagataaaattgttgaagcagctcgcgcttcggaagtaacccgctgatggccaagctgctttggatgactattaatcagacagttcttgagtagtagttgctgtttgcttgactgttttagctgtaagccgcaaaaagtttagataatggccggtcacaaatatcagcatcaaactcgctacaagccactcaccccactgtaacacgctcaacaagttatgcaccaaccccttgctggcaaagatagcaataaagcgggtcaaagcagttgcggaaatgacgagtggaaaggtgaaggcggcaaaactcggataaaacgacagccgcgtatactgtcgaatgctgaaaagggtcagaaaatacaggcactgtgcaaaaatcaacatgccggttgcaaatgccaaattcggatgcgtgaagctggccagataaccggtcaggcaaagcgaagccggtgcggcgatgatcgtcagtaagggctgtgttgcctcaggcagcggtattgtcctgacacgatgcagcacaaacggaaaaactgccacgtagatcacaaatgcaagccagaaaaggggctgcccaagtgctggcacgaattttccactggtcacgggaatgacgccgataccgacaaaggtgacaaaccagctcggataaatcatttgccattctttttgttgcgggagcaaatgccgtgaaacgaaaaaaatcattaagccaaaatggataatcactgctaatacccagatgacagtagcgatccccaccggcattccccaagcagttaaataagtgcacaagatcatcaaggtcatcgaaaatgtcggcgacaccgatgcgatgatcggatcctgtaaacttttagctgcgtgtaagggagtcaggcaaattttcagtaaaatcagtccaaacagcaaagcagctaagcctcctgttaggttccctactaattgccaacctgccagtttgtatagattacccaacgatgccaatcccagtgtcagtcccgccatcggtaacggcactcgtttcaaaaatgatctcataactgcctccttatattcttgctattaagtgtagcaagaatcatcgtcatcggctaaattgatcttttgcatgattaacattcacttattgaattaatcatggtgacgatcatgcgaccaatctaggctaaaagtttcttgccatgccaaactccgcaatctccggccagatgaggatggaacgcgtgacggcgcttcgagcccaaaaagcggtctcgaagtcgcctaacaacatcagcgacaaagcccggtcgctgtgttgtttgcacagctgatccccatccggcctacgattgcttcgccttggcactgggatctttaaaaccccaataaatcatttatgagaaaataaaaaatgaacaacttccaattgcgaaaattgttcattcttatttgacgcttatgaatgatgtcctaaccttagtttggaaaattctacacgagcaaaattgttgcattgttgagcatatgcaagccaatcgaataacgcatgtctcttgttcgcaagtatgtccaagcaaggacgccgccaagcgcggcatagatgaagaagttataatccacttttccggccacatgtgcaaagccgaagactgcggcactgattagcacactcacccattgccaggatcgccgcttcaaagagccgaaactgttcatcaagaaaccccgaaatagatactcctcaacgattgggccaccaacaactgctaataacttgattgaccacggatagtttttaactaaatcaagcaggttactttggttggcagcttgaggcgcgtgcatgacttgcgtgagcgtcacgttgatgagctgaatcaaaaatagcaatccgataccttgccagatcacgctagaaggatgagccaccgccagcgcaggttgttggcggtaaaaatgtcgatagcagaccatcaatgcagcaatcagtgcaccgaatacaaaaaccaaggcaccaatggccccataggcaccccacgtggcctcactgcggatcaacgcaagttcggcagacgaataggcgataaaacctgcagcaacgccaacaagttggacaaatgagcgaagaattttcatgaaggcaatcctttcttggcatgtttgtctttaagggtaacattttagaagccagggtgcatggtgaaacatagctgtgaagaggcgtgtcatgcttagaaagtgaagcataaggtcccaccataacgcgcgagtcgtcccaaaaacctacgcataaggagcttagccgtaataatcaaagcccgacttcacgtccaagaccacatactttccggtttctaaccgggttggttcgtgctcacaaaaaaacctgacagatttaatatctgtcaggcgcggtactatcagccgtctatcggattcgaaccgacgacctcatccttaccatggatgcgctctaccgactgagctaagacggcaaatggctgtgttgtttaaaaacaactgcctaattaatgtacactaaatccccatagctcgcaagtcctttttataaaaatgtagcgtagcaagcaaaaaaatgcgcattgccacagctgttttaactggccatgctgtcctttcataaaagagccgccttgccttaccgtctaccgtgccactcggccttgaactcggttagaaaatcttccataacctgttggcgatgcatcgccatttttttggccgcatcggtgttcaattgatccttgagtttcaacagtttttcataaaagtgattgatgacggtgccttctgttgtacgatactgagccgcggttaagtcagctcgtggtggtaaatctggatcatacatccgcccaccatgtgcaccgccatacataaaagcacgaccaatgccaatggcaccaatggcatcaagacgatcggcatcctgaaccagttgtccttcgaccggcaacgattgatggtgttgtaagtttgctttaaacgacatgtgatcgataatcgtcaataccatttggacttggtcagcgcgcatgccagcgtcgaccattgcctgctgggcggcggctttggctactggcacatccggaaccaatttgtcgtcataggtatcatgcatcgtggccgccgccaacacaacggctgtatcagcctctggtgtttgcgcagctagttgttttgctgtcgccacaacccgctgaatatggtcaaacccgtggccactgtgatcttgctcagataccttttttgcaaaggctgtcagctcttgccattcgatcatgaatcgttgctccttttcgttgtccaccattcagtcacctgctatgtgattttgttaacaaattgagcttttttctgccgtatttattgcgtcaatcaacctcaatccttcatactaaaagtatacagaggttatgaaaaaaagggggagcacttttatgaaaaagcaatatttggcagccagtcagtcggtgaatcaattcaaccgactcttttcaccggtttcaacatcggagattccattgaatcaacaaaacctgcttttctggatggcgaccgatgccacgccaagaacaccaacgagcttggccaaagagatgcacgtcaccaaggctgcgatcaccaaagccagcagcccgttgattgaccggggcttgcttgaaaagcaacccgatcctgaagattgtcgcagcttcaagctcgtgcttagcgaagaaggtgagcaagcaattgaggatctcgggcctgaatacttgggcaacttagaacgtctctatcatgaacttggcgagaaaaagtatctgaagttgatcaaacttctcagccaagcaactggcaccttggtcaccgaataaaccggtcatctcgtggtgcaaacacctcatggagatcaccacaatcaagcctgacgctcagttgcgtgaggctttttcagttgaccgggcgacacaattttgtggccgactgttgccgtttttctaggagcgttacaatgacattatcaggacgtagctagcccgattttgtcagtagccggctatgtctatctttttaaaggagtggtttgatggcaattcccgatcatatcagtgttcgcggcgcttacgttaacaacttgaagcatctcaatgttgatattccacttaacaaactggtggcgatcactggtcggtctggttccggtaaaagttcattagccatgggcgtgttatacgctgaaggtatgcgccgctacatgagtgctttgtccacctacacccgccggcgccttggccaaacaagtcctgctgctgctgactcagtacgccacattcctagtgccatcgctttgcggcagcggccaaccgttccaggcatccgctcaactgtcggtacggccacagaagcgctcaacgtcattcgcctcatgttttcccgtctcggctcgccggtttgtcctaatggtcaccgcgtgtcgccaaccctcgatattgccaaggcaatggatctgcccaatgacggtgaaagcggtatgggcatgatcacttgtccgacctgtggcgtccgtttcatggcttttgctgctgaagatttcgccttcaattcaactggcgcctgcccgacatgcggcggtactggtcaagcgcgcacactggccgccaaccggctcatccctgatcaaacactaacaatccgtcaaggtgccgtggcctcgtggcgcttgcccggtcgcaattttatgccttttgtcgcacaagcaatcggcattgatattgatacgcctttccaggacctgccaaaagatcagcaagaacaggtttggcacggtgaacgtaaaaaatacgccatcaatatccccagcaaaaccggcaaaatttttcatatggaccatgcacagtacgagaatgccttcaatgcggtcgaagattctttagcgacgaccaaaaatgaacgcgccattcagcggctgaatcgcttctatgagtttggcatctgcccgacgtgccatggcagccgatttgccccgaaattattgagccagcacctagtggatcaaaacattgctcaggttagtgatatgactttaacgcaattagccgcgttcattcccgaaatttatcactggttgccagcagatatgcagtcactggcgcacgatattatccaagaactgacgcaattgcttaagcccatcatggaccttggcctcagttacctgaccctgagtcgagccgcggcttccttatcgactggtgaattgcaacgcattcagctcagtcgcacgcttcggactgaaacgaccggcgtcctttacgtccttgatgaaccgtccatcggtctgcatgctgcaaacgtttctggattgctagaagtcatgcacggtttggtcaatcaaggcaactcgctggtcgttgtggatcacaacaccgccatcattgaggcagccgatcaagtgattgagattggtcccggtgcaggcgttgctggcggccgactcattgatcaaggtagccctgaagcgatcagtcatgatacccattcgttgattgcaccctttttaaccggagcggctcccttgattgttcgcccgcaagctggtgaacaagaaattaagcaaaccaaacaactgcaattaaccgtaactgatcgatttaaccttcatgacctgcatgtccattttccagttaactgcttctcagtggtatccggcttttctggtgctggcaagtcaactttgatttttgacgccctagtaccagcgctgtcagcaactgctgaccaaccagctccagcattcgttcgtgatcttgaccgcggcggcctgcgccatgtagttgcgattgatgccacgccggtcggtaaaaatgtccgctcaaccgtcgccacctacacagacattctcgaccatctgcgacaccttttcgccagtttgcctgatgccaaagccaagcactatacgagtagccatttctcttacaacgtcaaagccggcgcgtgcccgacatgcggcggtaccggcgtcattaacttagatatccagtatctgcctgacatgcagcaaacttgcccgacttgtcacggccgccgctacaaccccgaggttctgaaaatcaaatggcagcagcacagcatcgccgacttgctagatctggacgtggactccgccttgaccgttctgaaagacgaaccggctattactcacacattgcaaaccctgcatgacatgggcctcggttatttgcatttaggtgaaagtactccgacgctgtctggcggtgaagcgcagcgcctgaagctagttgcccacatgggacgctcccaaaaagacacgctttttgtcttcgatgaaccatcggtaggtctacaccccctggatgttcaaacgttgatcgctgtttttcaacggttgctcaaaaccggtgcaacggttattgccatcgaacacgatctagacgttatcgctaacgctgattatgtcttggatctcggaccaaaaggcggtgcagaaggtggccgcatcatggctgctggcacaccgcaagcaatcgccaaacaagggaaaggtgaaactgccccttacttggcggcccatctggcggcttttcacgttaagtaggcttgacaaaaagagatgcctcggaaagtgataaccgagacatctctttttcatacatcaactttaaacgttcaagatcgaatcaatgtggctgatttcttctgcactgaaggtcagattttcggttgccttcaggttgtcttccaaatgatcaaccgaggtggtcccgatgatgacactggtgacgactggatcacgtaacagccatgccaatgccatttgcgttaacgtctggccacggtcatgtgctacttcgtttaactcgttcaacttcttcacaaccgcgtctttcccatgggcaaaagtggcttggttggtcggatgaattttgaacgtatccggaataccattcagataccgatccgacaacaagccttctgaaagcggcccataagcaattaggtcggcaccatcggcttgaagagccttcgttaggccagaagtttcagcctcacgattaaacatgttgtaactgaactgattcagcacaaatggcgtatgcagatctttaaacatcgcaatcgcatctttggtttgctgggtatcaaaattcgagatcccgatgtaaagtgccttgccatcacgcaccgtctgatcaagcgcattgacagtttcttctaaatcaaccgtatcatcaaagcgatgcgcataataaatgtcgacatagtcaagctgcaggcgtttgagtgaatcattcaagccttgaatgaccgctttgcgcgaagtcccaacaccatatgggcccggatgaatctcataccccaccttggtgctgatcaccaattcatctcgataagccttcaaatccgttgctaaaatttgaccaagcaaactctcgctgctgccaaaaccaggttcatgatcaccattaccatagtgattcgccacgtcaaaatgaaagacaccatgatcaaaagcgtctaaaataaccgaacggcgtgggccaaatggatcaagattgccataatgctgccacaagccaagtgaaattgccggtagcatcaaaccggttttcccggcatgacgaacaggcatcttgtcataacgatcagttgctgcataatacatgacttttccccctctacacgttcacgagtgcagaaacctgcatacaagcgccttgaacgcttatacgccagtttcgaccgcaccagctcacgctttgacttaaacgcgctcaccgacccaggaatcatgtatacaagccctgacgctatggtcaaaattcaaccatcgtattcaagccaatttgcataaggatttctaaccgggctgtctcacgctcataaaaacgtttaccatcttctatggtggcaaacgttggcccaacaagcaacttaaaaagtcaattttttaatataaaactacttatttttcaaaaaaatcgttcaaaaagttagctacaccatcatccacattggcatctgtcatatagcgggcagtctgcttaacctgtggcacagcattttccattgccacactaataccagcagccttcagcatgccaagatcgttgagaccatcgccaaaggcaatcgtttgctccggaccgattcctgtgagcgtctgcaactccttgacggccgtggccttatcaatatgtttaggaatgagttcaaggttagtatgttcagaggctgaaacatgtaaaacatcccgtgcttctaacgctgccttccccttagccaatgcttccgaatcatgcgggccaaaaatgatcccattcgtaattgcaggtgcatgtgctaacaaatcatcaactgaaggtaaggctacaacgtcaatgctcaccgagctgggggcaaacttgcgtgcagctgcttcaatggcaggcggcactttacctgtgtaataaacggtatcatcgctgaaatacaaggcgttcaggcccaactgatcggtcacagtttcaaccgccgtaagtgccccttgccccaaaacatgatgcacccgctcgccggaaaaatcgtagacagcaccattcgatgcaataatcgaagcttctggttcgaattgtttggccacaacctgcgctaaagcgtgcatgcgcccggtggcaacataaaaagaagcgccgctagcaacggcagctgcgatggccgctgccgttttgggcgtgacgtcatgatgattggcggttagtgtgccgtcaatatcactaataattaagtatcgcggcataaccgttcctttctaccctaaggacacaaatggcgaccgatcaccatcggccgccttatttgttaaagtccttgcggtaatccggcaatttgatcagcgtaccaatcgttccatggtgtttcaggtgcgccttgcgcattaaaagttaccttaacttgcttcaaaaggtccaacaagttaccggatcggttagtcagaagaccggctgtcaattcctcacgagtcagtggttgattatcaagcaagtagtgattaatatctgctagattcccctgcgtatcaatttgggaaaaaacatcgagaccggcgccgaagaagcgatccaagtagaactttgcaaaagtttccaatgctgtatgttgtgctgtttcatttaattgatcaatcgttgtgttgcttgctgccataactattttcgtcctttctgctttattccattataaccacttttggttgcgttttggaaaacatcgtcccacaacgatcacaagtttcacataaacttacacgttgccgtcgaccaacattttatgagtgctcctggtcgtattcattaatgaaaagatagtgtttgatgacatttttataggaaatcaaaaatgccataaaatattcgtcttttttgaaattttacgactttggtctcttgctattatggaacggttgttataatatgccaaatatgttggggatccgtgaaaggctggagattttatggaaaaagaaaaattacatctcggtgacgcggttgtttgtcatgtcaaagaagatatggaagcaccttttaccggaaaaatagaaaaggtttatgagaactcggcgctgttgagtattaccgattatgctgataaagaccggcagaatgccgcagagctcaactttaagattgtcgcaaatttccacgcgatgactcagaacctcggcggcggcactgtcttggcgttcccgccagaaccagccgaagagccaaaaaaataaacgttccaatcacattgtctcacaatatcactggcatctcgtgccagtgagtggttgttattatttacttagggatcttcaactcaaacaaacaaagtcaaaccggtcgacaggacagcctgctgatcggctttttttagttgatacccaagacaactttcatggtcattcatgaaaatcagcgtaaaatgaggcgcaaacaatctatcgcaagagcgcaagccagttaatctcgaagtcttatatgcaggtttctggcctgtaaacgtgtttaagggagcgaccaacatgaacgagaaaccctatccagtccacgaaagtcttttgatcggcacactgctcacagcagctgctggcagttttgatgctttcacctatctcttacacggtgaggtattcgctggcctgcaaaccgggaacgtcatcttgttgggtattcatctcggtcaggcgcaatggactaccgctgtccgttacatggtaccgatcttcgctttcatgttcggcaccatggccacccgcgcactgcaactgcaggctggcaaaaaatcacaacctttaaccgaacaacggcggctcattcaatacgaactcactttgattcttatcgtgacattgtttggccactggctgcctgatctagccgccagtgctttggtttcactcatcgccgccgcgcagctacaggaatttcgccgtttaaaaggcggcccttttacttcactgatgatgaccggcaacctacgcaccgcggcacaaagcctttatgatggcttcatccgcgggcagcaaaaaggccgcaaagacgcggccacaattgggacgattattttatcatttgctaccggtgctgccgtgacaggtattttaacgaccctgatcggaacttatgctttagtaggcgccgctttgtgcctcgtctggattgatatcattttttggcgtgatcaggttgagcttcactaagccacttaattagcggcttgacctgcatgcaagaaactaaggtcattgaaatccgtcacagtaaatcgatcattttcccacatcagtttcgtcacgctagcattgtctagcatttcgcgaccatcaatgttgtagtgaacataattcaaccacatgagcgccgctgtcccgtgtgagacgaccaatactcgctcccagtctttggcgactgcctctacagcaatcgcacgcaaagttcgattcaagcgttcctgcaccatgcggttcgtttccgccttgttcgggtgctgatccatattcgccgtaaaagctgcatctgccgtctgggccaacgttatttcttgattggccaatgcatcgtgaaagttagcaatccccatggtcgctaaggaaaaatcatttgccagttgaccttcgaacttgccgtaattttcttcacgcaaccccatcaaggtcgtcaccggtatcggttcatccaaaccgctcaaaacaaaatgggcagtgtctaccgcgcgggttaaatcgctggcaaaagccgcgtcaaagtgaatgtttttagtcttaaagccttgacccaaagctttagcgtccgcaatgccttttggcgtcagtgccgaatcggccatgccttgcactcgtttttgtacattgaattctgtttgcccatgacggacaagataaagcgttgtcatgtctagttgactcccataattttcatttttcctgcgacaatggtttaagccagtttcaaataatctgccaaatagtttgccaccccatcatgctgattatcgttaggggtctgcgcatcggcgattgcaagaatcgcaggacgggcatttttcatcgcaacaccatgacccgcaaactgcaacatatcaagatcattcatgtcatcgccaaacgcaatgatatgcttttgatcgattccgtattggcccgccacgtaggcaagtgcccgtgacttgctggtattcttacttgtcacttcaagcgcagtgtattcaccactccaagcaccccacgttttggccgccaaatgcggatacaatgcgttgacttgttttgaaactggatcaaaagttttagccgtcataaacatcgtgaccgaaataggcggctgccgcaaaccttgctcatctaacagcgccttaggatgcggacgatctggcaaaaacggaatgttcgcgtatggtcgatcagccaccagcaactgtttcccttctgccaccataactttaaaggaaaagtcgcgttttagctgccgtaacgatagtgccaccggaatgggaatggtgacctcttgctcataacgccagtgttggtgcgggatgtgaatcagcgcaccgttgaaattgatcatcgggccatgaagctgcaagtcatcgtagaaatgttccgaaatcgaatccggacggccggttgtaatgacaacgagatgtcccgcggcttgtgcctcgcggaggacggcaatcgtgccagcgcttaattgtccatccgcattcaaagtcgtgccgtctagatccagtgcaataagatagcgttccatgcagcagcctcttttcaaaattttttcttagtgatgtgtctagccatctaaaacgcgttcccctacaatagatagcagttagaaagcgaggaaatcatggctgaatcaattgtactttatacagatggcggtaatcgcaatacaggaaatcaggcgggtggatcggttcgccccacggataaaagcgcatgggccgcattgctgatctacggagatcacgaaaaaatgctatctgacggcgactatggccgaacgaataattatatggaaattatggccgttattcaaggcttaaaagccctcaaacgcacagatattcccgtcgatgtttattccgactctgcttacgtcatcaacaccatgcagcaacgttggtgggtaaaatggcaacaaaacaattggcgcaaccatggcaaaccagttaaaaatgccgagctttggcaggccttgttgcaccaagtcaatcgctttgaaacgattacctttcacaaggtcaaaggccatgccaccaatcgcaacaacaatcgcgtcgatgcggccttgaatcaaaccatggaccagcttgacgatcatgtttaactattttacccctgatggccgagaaatgcttcaccataagtctcagctaagaaactatgaatcacctgctgcatgcgctgcacagaaggtgatttttttatggtcggattaatcacgagacacagcgtccgctcaaagggctcagaaaatggatacatattgacatcgccaactaacttctgcaccgctagtttcggcaaaatgcccatccccaaacctgattccaccatcgacagaatgctttggtcatcaatagaataattaattgcattgcttgacacatggtagcggtccaacgcatttttggtatctcgatcatagtcaatctgctgcaaaataaagttctgcttatcgacatcggcctgtgtcactgtgcggccgtttttaggcttgaattgcttgggcgtgatgcagtagatgggatcctttaataacggctctaccacgacgccagggccaactggtaaggaggaaaagccaatgtcggcagttcccagtcggaccgcctcaacgatccggttaaaagtgccttgcaccacgctaatttcaatgtgcggatagcgctttttgaagcgacggataattgttggcagccaattcgtcgaaaccgacgagaacgcaccaatgcggatacggccggtattaaccccattaatgttgtccgcaacctgcgtcagctgctcctcgagattttggatgctttgaataatcggcagcacctgcgccccatcttcagttagcgccactcccgttcgattacgaatcaagagtgggaaacccagttctgtttccagctgactgacactatgactcacggcactcggcgttacattcagctccgccgccgctttcgctaatgtgccgcgctccacaaccttgctaaaaacttcataagaaaagttagccatttgcccctccttgaagtgacaccaactgtcacttcgttgtgataaatccttttagactaggaataacagctgttcgttccttttaaggtgaataaaattcatcataaactgaaatagttgagctttactcaatcatacaagccgttttacactagtgtcaataagaaaacgttggtacttcaccaaagcatcaacgtcataaagacgtcggcacccgttttaatcgcaaacgtcaaagggggattcatcatgaaattcgcaacacgtactcaaaaaactggtcattcaggtttagaagatctatttgctgcttctggtccaaatgtcatttcatttgccggtggttatccagatcgcgatttattcccgacaaaacaacttaatcaggcatttagtcaaaactttacaagtggcgatagggaattgcttcaatatgccagcacagaaggttacgaaccattacgtgccaagattgcagctcgtctgcagacgactgggatgcaggtcgacgccgatgacatcatgatgacccaaggcgctcaacaaggcatcgatctagtggcacggttaatgttggatccaggcgacggtttggttgttgaagccccaacttacttaggtgcacttgctgcttttaacgcctatcaacccacctattacgaagtaccgatgcaagctgatggcatggacatcaatgctttacaacgcattctaatgagtcgcaaagtcaagttcatctacaccgttcctgattttcaaaatcctactggggttgtgatgtccttggccaagcggcaggcaatcattcgcctcgccaaccagtatgatgtcatgattttggaagataatccgtatcgcgaccttcgttatactggcaaagccttgccgacgatcaagtcactcgacacagaaggacgcgtcatctatcttggcagttttagtaaaattctttctccaagtctgcgtatgggctggttggtcgctgcgcccaatcttttaaaagagttgctggccttaaaaggcggcagtgatctggaatccagcaatctggtaatgcacgggatcaatacctatatggaaaataacgatcttgatgcacatatcagggaaattcaggattgctatcgtgagaaaaagaatgccatggtggcagcgatgaagcgctatctgccagaagaagcgcacttcactaatcctgacggcggcttctttatctggctcaccatgccagccggcttcgatatgggcgcgttcatgaaagaacacctattaccggaagccaatatctcctatgtgccatcaaccaatctatatgcgacagcggctttgtccaacggtgcccggttgaacttcactggtcctagtctggcgcaaattgataccggcatgaaagctttgggtgcagcattaaaggttgctctgcaacacaatctggttgccgaacaagcctaggctataacgcgttcaaaaaaactcggttaaccttaacaaaatgacaacgtaacgatcacattttcgtcacactttgccggtagtattaacagcatagaagtgagccacccactcattcctaaaccccaacctaattttcatttttctcctccaaagaaaaatcggtgattggcccccatccgatcacccaataacaaaaacgcccgctgcgatggtagcgggcatttttgtgttttgaagacaaaaaatcgccgcacactttctcaaagtgttaacggcgattaatcaaacatccatcagttgcttaaactaaccgatcaaccccgaagctggcagggtcatctttcttgccggctttcttttcagtatcagtggtcgttgtcttttcggtctttttatcagcagatgcctgatcgtctttcttatcatcctgcttctcatcggcttcttcaggcttctttggcgcaacttgttcacgaatcttttcttcgatttccttagaaatttccggatgttcatccaagtagtgagatgcgttgacaagtccttggcccaaacgttccttgccatagttataccaagagccagacttggtgatgacgtcaatgtcattgtctttatcggttgccaagttaatcatatcggtattgtgttcaatcccgtgaccaaatgacatcgtggtttcaaccgatttaaacggcggtgcgaccttattcttagtgactttcagtttgctagcgaagccgacaacatctttgccgtctttcacctgctgcccacgcttgacttcaatccgtacagacgcatagaatttcaaggcacggccgcccggtgttacttctgggttgccaaacatcacgccaactttttcacgcaattggttaatgaaaataaccagcgtattggtattattgatcgaaccggccatcttccgcagtgcctgcgacatcagccgggcttgcaagcccacatgactatccccgatggcaccttcaatttcagccttgggaaccaaggctgcgacagagtcaatgacaacaatatcaacagccgctgattcaatcagcatttcagcaatttcaagcccctgttccccagagtttggctgagacaacagtaagtcgtcaatatttacgccaagttccgccgcatacttcgggtccatcgcattttcggcgtcaatgtaagccgccttgccgcctgatttctgcaattcggcaatagtctgcaacgcaatcgttgttttcccggtactttcaggaccatagacttcaacgattcggccacgtggtaacccgccgacaccgagtgcaagatccaaggataaaatgcctgttgagacgacatcaaccttcagttctggtcgatcgcccatcttcatgacggcaccttcaccaaaggctttcttgatcttctgaagggctttttctagttcggtatcgcgatctgtagcatcggatttagtattatcattctttgcggtcgttttcttagccatacttgtctccttaaatgcgctcactggcgcaaaagtctgtgtgtaagcaccttggtcacaatagctcaaccagaccacttatatcccagtctttaaccatgccagtgcacgctttgtcttataaaaatgcgccagcagttccaaaaacctgtgcacgctattttaaacatatacatccgagtgtcaatttacgctgtctccattatcgaacatgcgtttgttttttgcaagcttttacgttaaaaaagtcatccccaaaaattgtttgcaggtgactgctttattttacctgatactgacacctttttggtaaaaatgacgcgttatttatggcacacaagcatggtatgatgaggcgattggcttgatactacaaaatatgtaaacgaggaaaatgaaataatgttcatgggttctattgtcaatgggttgacgattatcggtggcggactcttaggcttgattctccacagtattagcgatcatgctaaagatactgtcaccaaaagtcttgggcttggtaccttcgcattgggcattcaaatggccttgcagacaaaaagttttattgttatggtcatcagcctttgccttggcggcttgatcggtgagtggttgcatattgaagatggcatgaaccacctcggtttaatgttggaacagcgctttgcccgcggcaatcagcattttgcggaagggttcgtgaccgccaccctgattgctgtcatcggtgccatgggtattttaggcgcgattcaggcgggcgtttctggagacaataccacgctatatactaaatccgtcatggacgggttcatggcgattatgctgaccgcgtcactcggggttggcgtgatcttttccgcgttgccagtgatcatttatcaaggcacaatcacactcttcgccagttttttagtccaattcgttcccaaggcattgatgacgaacgcactccgcgaaattggtgcagttggcggcttaatgatcttggggattgggttaaacttgatgggcattaccaaaattcgtatttctaatctgctgcctggcttgctagtccttgttgcgatcctaactggtcagtattttctatgattaatgattgaatcatttaggaggaggctattggcagatcataaactgaccggtttgaacggttgtggtgataaagcagagcagatttttatcaaaaaaacgacccctgcttcactggcatgagtcgtttttttttggtaaaagtgccgattatgattcagaaattcggaatgagccgctgcttttggcgatggaaacgatagtaaaccagtttgcaatgccaatcacgcacgacacccagcaagtgcgaattggcatcataataccagtagcgcagatcatcttttaggtactgctgattcaaccatgcatgatcgtgccgcaagaaagtataactttcaagcatgtcctgctctcgccaaacatcaggcaataagaattggctacgggtaaaccgttttaaaaaccgatctgaataataaacccgctcaatgcgaccgacaaacaatgccgtctcgcctttacccacatatggcgccatgggcacaacaatcaaaccaccgcgtaaacgttcaaaccagtctgtttgctgactgacgttaatggcacgtgtgacatccttgggtaaccgaaaatccaatactaaaccatccgggcgtcgaacccgagcaacgatgtgtcgttttttcatataaagttcccccaaaacaagtgagcgcgagccagcgtgggtgaaaccggagtgtaagcggccttgggcatgatggtcgcactttgaccattgcgaccaaggtccttacacgcaggttgcagcgctggtgagcgcgttataacttggcctataggcgacttgtactaatggcaaaagtttaacactaaatgacctcatctgcattgaaagcgcttgtttcgacaaagtttttttaaacagttctgtctgtaaagcattgttctacgctcttttttaaatgtgaacaatgtcgccacaaaacgataaccaattgttggatttgtcttcacatttcgttcacaccctgccggtagtataggaaacatagaaatgagccacccactcattcctacaaaccccaacccaactttttcatttttactcctccaaagtagcaatcgtcgatcgtcccccaaacgatcgcaacaaaagggccgcccacccagcggtcctttttgctgcacccgatcacaagcaacgtgaaaaattcccaatcaaaaatggcctcctgaccgaacgtgtcagaaagccattttggttaattaacgattaaatagatcatacaatgcatctggtgtctgtgctgcttggaaactcttgacgaagtcttcgtgtgtcagcaactttgccgtattggacaagtacttcagatgactgccgctgtcatgttccgggatcaagaaggagatcacggcattgacaggcttgccgtcaaaggttttccactcaacaggttgcgccaagtgcaagatcaacatagccgatcgtttgatggtttcatcttgagcatgcggaatggcgatccctttttccatccctgttgatccttcctcttcacgcgctacgtacttcttgaaaatggcgtctgcgtcggtggcaagtccatccttgaccgccatgtcagctagataatgcaaaacatcatctcgcgtcttagcaggtacgttgacctcaataaattctttgttgagaatttcgccaggatcaaaactttgatcattatcggtggttggtgcaggttgattgcgagcatcgtcgacagctattggggcagcagcgacatcgtcatcggcagcttcggttgctaacgccgcttcaacaacaccggtttttacaccacgttttctagccgaccgaccagcgatcatggcaagcagaacacctgatgctgcggcgcctaccagaatccatgcaacccagagaaatggcttattgaccaacggcaatacgatgaagccgccatgtggtgcaggcacctgaatgcgtgacatgtaagtcaaaacagccgcaattgccgaaccaaccatgaatgctggaatattcattaacggattcttcgcggcgaatggaatcgcgccttctgtgatatgcgtcgagccaagaagtgcattgacatagccagcactgcgttcatcgcggttataagctttcgggttgagcagaaccgaaatcgttgttgccaacggcggggcaatgcaggccgctgacacaccagccatgaagaagtaattgccttgtgccagtagtgccgtcccagtcagataagccgctttgttaatcggtccgccaaaatcagcggcacacatcacaccaacgacaatacctagaatgatcgggctggagctttcaagtccttttaaccaagccattaagcctaagttcatcgccttcattggcgtattaatcaaaaacataattgatccggcaatgaaaacgcctaataccggatatagaaaaatagcttttaacccacggaactctctgtcaggcatgaaagcaaatgccttttgcaataataagatgaccaacccggccatgtagccaccaacaatagcgcctaagaaacccgacccgttgccaccgttataagcaatcatgccgactgccatcccaacgatcaagccggaacgcttggcaacagcttcaccaatataagcagccagcactggcaccatgagtcccattgctgcaccgccgactgcattcagcatggctgcaaactgattgtattgagcgttcttgggatcggcagaataaatgccccagaagaaggaaatcgcaatcaggacaccaccggcgaccactagtggcaacatgtgtgaaacaccattcatcaaactcgtataaattttgttcccgatacttgctgaactagtttcggtcttttcaccggcttcagccgtggctttgccacctttaggcatgaacaccgccgtatcgctgcttaacgcttcttgaatcagtttagccggttcgcgaatgccagcagcaactgggacattgaccagtggcttgccagcaaagcgatcggcgtcgacatcaatatctgatgcgatgacaacccctttagcgccgctgatttcttcttgtgtcaacggatcgtccaccccggtttgtccgtgggtttcgactttaattgtcaagcccattttcttagccgcttgttccaaggcttcctgcgccatgtacgtatgagcgataccagttgcacagcctgtcgcggcgattaaatcatactttgccattacttaaccctccatcttgcgaattttgatttgtcctaacaactcatcggtatttgaaaaatcagtgatccatgcctgtcgtgccgtgtcactgccagccgcaatcgccagtttcagcgtctctgctagatcatgatgctgatacaacccggctaaaaaggttccaagcatcgtgtcgcctgcaccagccgtgtttagaacggcaattttaggagcattgccaaccagcgttacatcctgattcatgaacaaggcacctgccgcaccaagtgacactaaaatgttctgtgccccagcttccaatgcccgatggcctagcgtaatcatggtcgttaaatcagcctccccggtctggtggaaccaattcatcaactcaacatcgttcggtttgaccaacagcggcttgtaagccaatgcctcaactgcttcaggatacgcactgtcaatgatcaactggaatccatttttttggctcaatgcacccagctttaataaaaaggccggcgcgatgccttgcgcaaaactaccagacacgcataaccaatcgtctgaccccagcgtggttaattgttggtataattgatttaatgtgtccgcactaatctgcggccccggattgaccaacttatactccgtatcggttgtcacaacccgcgcaaagacattaatccgggtaaagccagcatctttataaaaatgatttggcacaccttgttgcgttaaaaagtcggcgatgtaatcaagcgtaaacccagcaccaacgccaagcgccgtattgtccacgccacgccgtttcaaaatgcaactgacattcacccctttaccattggcttgcacatcataactgtcggttcgattaaccgtatttggcgccatctgttgggttttaataaatagatcaattgcgggatttaaagtcagggtataaatcaagttaagcgctcctttgtgtcgtttgttttgcttatccttatgttaaccgctttcagccgaaaacggttttcagtttcaggcaaatctgcgccagtactgaaaatgcttttcaggaggttaaattcatggctacactcagtcccaccgaagcgtacctttgggattacatcgaaaatcatcagcaagccgtcgttaacgcatccatcacccaactcagtactgcggccaatgtctctcctgccaccgttgttcgcaccatgaagaaaaaggggtttaatggctataccgatttccgccacgatttgctaaaacgcacaggcgatgccgcaccgttcagcattcttgaccaagttgacgaccaaatcaaaaaagtcattatgcaaaaccaagtggaagtctataatacgctggaaaatttgaaggtttctgtcattgaagactcggttcaattgctagctaaagccgaaatcgtcctgattcttgcgcgcggcttatctgaatcaattgcgtcggaagtcactttgaaattgcagctcttaggtaaatacgccgagttttttagtgatccgaatatcattcaaacgattgccggtcaggtcagcccgaaggcagtcgccattactatcacgttgaatggcgaaaccccagagcttgttgctgcagcgaaaactttggcagcgcgcgatattccacaaatcattttgacaaccaacgcagaagcgccaattgtccaatatgccgatgagttatttgtcgggtacaaatccaaagccgcttacttcgacaaatatgaggtggcatcacgcctgccgctgcaagttatgagccgtattttgctggatagttatgttgtgcggaaacgtgggcagaaaagttaacggtcactagcaggctttgataacttgctcgtaaccacataaaaaggcaatgatcacttgagaaaacagtgatcattgcctttttcacttcatccaaccatcaactatgcttttggtagcggccgatgtttaaatagttgtgtagcggcgaccgcttgttgccagccagcgtataaattctcgcgccgggcttctgacatctgcggttcaaaccgcttgccgatcttgaaaatctttttgagttcatccgtatcttgccagaagccaaccgctaatccggccagaaaagcggcgcccattgccgttgtttccaaatttgccgctcgttccaacggcttgcctaaaatatcggcttggaattgcatcaagtaatcatttttagcagcaccaccgtcaacacgcaaggcggggacagcgatttgggtatccttgtacatagtatcgaccacgtcgcgcgtttgataggctagtgcctgcaaagtcgccttgatgaaatcggttttcgtcgagccgcgtgtcagcccgaaaaccgcaccgcgggcttcagcatcccaatatggcgcccccaaacctgtgaaggcgggcaccacatagacttcatcattactagttgacgcattggcggccatctcagtatctggtgactttgcaaccaaccccatttgatcacgcagccactgaatcgctgaaccggcgacaaacaccgagccttcaagtgcgtaattaattttgccgtcaatgccatacgcaatcgttgtcaacaaattgttcgcggacatggttggtttttcaccggtgttcatgacaatgaacgagccggtgccataagtatttttaaccataccaggtgccagcgccaactgaccgaaaagtgcactctgctgatcgccggccatccctgcaatcggcacagcactgccaaagaagtgataagccgccccttcgccgtatatttcggagttactgtgcacttcaggcaggatcgcgcgcggaatattcagcagttgcaggatgtcgtcatcccaatccaacgtatgaatgttaaacaacatggttcgacttgcgttcgtataatcagtcacgtgaatagcgccaccagacaacttccagcttatccacgtatcgatcgtgccaaacaataactcgccattttctgcgcgctgctgggcaccgggaacatgatccaaaatccaacgaattttagtcgcagaaaaataggcatcaatcaagagaccggttttctcatgaatagcatccccatgccctgctttgcgcaactgttcagcaatgccattcgtttgccgtgactgccagacaatcgcgtgataaatcggcaaaccagtctttttatcccagaccaccgttgtttcacgttgattcgtgatcccaagtccggcaatttgactaggctgaatcccggtcgaaatgaaggtgtctgcgatcgttgacaacacggcttcccaaatttcattagcatcatgctcaacccaaccaggttcaggaaaatattgggtaaattctttttgcgcctcacccaccatgttgccggcgtgatcaacgataactgccctcgtgctggtggttccttcgtcgattgccatcatatacttgtctgccatttctgtatccccctgctaatgactgttgccgctttcaattcagtataccggatgtagcggaggaggttaaggttcagatggtttaaaaatcccaccgcctcaagttgagccttattgcaacgattagatccgtcatgctataatgaagatacaaagaggggcgctggcctcaaacagcactccctaacaagaccgtcagcaaaacttcgtcaagaggtttggtgacggtcttgttgttgtctaagatttgaaattgacgtcgttgcgacaccttgatactgcatgctataatgaagacacaaaagggagcaccggctgctaccagtactcccctgacaagaccgttgaagacggtcgacattcgtttaatcaatcaattaagaccgtcaaactcgtcaaaagtttagtgacggtctttttgattgtctaggattgctaccacaatcgtgatgatgagcgcaatcaatgataatatgaaaccaccaaaaaccaacatcagcatcaaggcgtcagcaacggacaactaggcacctcccttcgtatagattttgatcatcgcgcataggcgaccacctcacaatacgttggatttgccaaccgtcattcactttcttgtctcatccactatgccataccaaatagcaaaacgcttagagtcgcaaagattctaggcgttttttaattgctcgtgtcaccgtggcagcgactgcttttgaaaatatgcaatacttttccagcagtgcttacaattctggctcaatgaagccataggttgagtctgtctgcagcccccagaactcaggaagcttgtagctgatggcgtattccaaatgacttgctgcgtcaaatggcaggtaggtttgccggaactgctggataaaggtttgttgttcagggcgctcgggaaaataagcggtcacaagtgccgcatcaatggtccccgccaaattgcgctgggtgtatggcaatttgtacgggtcaagtcggctgtcatcacgaatgcgttggtacacggataaaaaagcctcagggtgactaatctgatccgtattgatataggctgcattaatattgttaaccgtgtactgaacggcttggtcaccgatcatgcgcaatcgtttgatgacaacataagcttccttgtctgccaagcgtagattttgccgcacaactgggtcatcgccaaaagcaacactcaaaaccttcgtccattctggctcggttttggccatattgagatcagtcaggtaaacaacccgacgatgactttcttttgccacaaaagtgccgcggcctttaatacgtgtaacgcgattttctgtttgtaataagttcaaaactttgaccgcggtcgttgagctgacatcaaagcggcttttaagttctgcctcactgtaaaagcgatcaccttgattgagacggccttgatcaagctcgctaatcaacacatctgcaatttcttgatactttggcttggtcatgacagagactccttgttttccgtacactttcaccaaccccatttttgagttggtgaccgtttactcgtaatctatttgggcaattcgaaccacccagtcactcccataaggataacccgttgcatcaactgtgagaacctttttatctagatcttgcgtaaaactcagcacttcatcattatctagccagtgaatgcgctgaattggttgaccaatgccaacaaacgaacgcggattaaccccttcaccgccaagcaccacattatcattaccgacaacttgcaggtccaaaatacataaaaaatcatgcttcgatgtgtgcaagacaaagtcacgcgtaccatgtgccgaagttactggcacaggtcggcctttgtacaacacgggtgccgccatcgctgtccatcgtcctagtaagtgcatgtatgtttgcgctgcggcaggaatagcgcctgtccctgttagaccaatattgaccaagatgttagcgccaatgtgccgcgcatgtgcgaccgtttcaatcacctcagcaggcgacttatagttaagatcgttggcagcgatgccccaatgttgatttaaggtgattgaaatttcaccagcaacatatttttcgttcggagcaccgtggtaaatctcatcaggtgtgcgtcgctcgtaagtcaccacatcaatttccggatcactcacctggccgcgattctttaagccggtattgttcacaatgatcgcgttaggttgataatgccgaatcatgccatacagttcaggcagatgccaatcaacgtcttttttattccagttgccgtcaaaccaaaacccgccaactgggccatagttgcgacataacacctcaaccgatttttgcagatatgttaaatacgccggaaaatcatcatcatataacggtgtgtgccaatcataggtggccatataaaagaatggtaacaggtcttcttcacgacaagccgccacgaattcggcaatcaaatctcgtcttgctggcgcatgcatgacatcaaaatcgcttaatcccttcgtgtcataaagaaaaaaaccttcatgatgcttagtcgttaaaacaatatactttgcgcccatcgcctttgcggcgtgggcaatttttttgcatcaaattgttcagccgtaaaagtcttaatcaactgctcatagtcatgctgattgcgatggtgaataaattccgtccactcaccaactgccatctgagaatataggccccagtgaataaacaatcctaggccaaggtcctcataatgttgaatgcgcggtaatggttctgtcatgtcttcacctcatttgttttcttatgacacatatcctaacacattaagtagccagatttaaatttatttttatctagacctattttcggcttaaccgttttcttttgctttagtacagaattataagaatgtcccagagtgttgccgccgacaaactatcgtgctattatttgcgtgtgaagttaacttaacacattaagaaaaatggggtgatataggtgtatgtcttcgcaagtcatggcgattatgctgccgcaacactcgcaagttgtgagctaatcgctggcaaattatccaatttcgccacggtcacatttcatgatccaatggggttggctgatctcatcgcggcctatgaagcactgttcgcgaaagaaaccgacccagccaattttcaaattatcaccgatattccaaatggatcacctgccaatgccgccttacagttcaagcacaagcatccaggtgttcgcgtcttctccgggttgtcgctcggcttggcattggcgttagcaactggtacgcccattgccgaagcgcttaaggagtcgcaggctattgctaaagaactctttctcaaaggcgagtctgaagctgaggcgccggcagacacggctgtgacatcaactgaaaaagcatttgttcctgcacctgaaaacacaaacactggcgatccattgatcaacgtccgggtggatgcccgcctaatccacggacaagtcgccaccatgtggacacgcacgctgaatgccacgcgcatcatggtcgttgacgatcagatcgtccaaagcgaagttcaaaaaatgacgctaaaaaccgctgttcccggtggcgttcatttaagtattttgacaccatcaggagctgccaaacgaattttagcaggtaactatcagggacagcgggtttttgtcatcgttcgcaatccaaaagcattacaagaaatggttgaagccggtgtcaccttgaaagccgtcaatgttggcaacatctccatggcggcaggtgccaagcaaatcgccaaaagtgtcgccgtcacgcctgataatatcgccgtttttgactatctaacaaaacacgacgttgagctatatcaccaaatggtcccgaatgatcaaaaagttgctttcaatacgctacttaaaaacaaagcgtgagctggaccgtttagaaaccggaacataagcggccagggtccttatgtgcaggtttctggtctggcgaacgcgtttaaaaaaggagagtgagttctatggcaattgcatggtggcaaattctactactgacaatgttggccttctggatgatcattgaccagatcaccgtcggcattttaacaaattatcctttactctacggttttgtatccggcatcatcatgggtgacgtcaaaactggcctagttgttggcgcaacgctgcaattgatggtgcttggtgtcggtacttacggcggcgccagtatgccagacttcatgactggggccatcattggaacagcctatgccgtcatctcaggaaaaggtatcaacttcgccattggcctcgcggtgccagttggtttattgatggtacaactggacgttcttgcccgtttcaccaacaccttcttcctacatcgcgtggaccgctacatcgaaaaaggcgacacgaagcgcgtcgcccgcaatatcgtttacggtgtcttcccatggggcctttctcgggccattccagtgttcgcaatgctcgttgtgggtaacaccgtggttcaaaaagtggtcaacgcgatgccgcaatggctatcaaaagggctaaccgcggctggcggtattctgccagttgtcgggatcgccattttattacgcttcctgccgacaaaacgatttatctcgtacttagtcattgactttctggcagcggcctatctcaaggtgccgatgctgggcgttgctttgctaggtttggcattagccatcatttattacaaacaaagcaaccatcaatcaagtgatcatcatgacgatcaggatacaaacaaaggaggctatgaaaatgccatcggcgaatacgaagactgatctgccagtcaaactcaccaaacatgatttatttcaggcaaactggcgctggctttggggcagtcaaatctgttggaactacgagcgaatgatgtcaaccggttacttatttacgatgttgccaacattgaaaaagctctacaaaaatgatcaggatctcatcgaaatgatgaagatgcataatcaatttttcaataccaacgcgtacgttggtggcttcatcgtcggcatggacatggccattgaagaaaaacaaggccgcaaagctgaagacaccgttgccggcttaaaagcgggcctcatgggtccttttgcaggtgttggcgatacgattgtcggcgtcatcctgccaacgattttcggttcaatcggcgcgtatatggggctgaagggcaatccaaccggtgcaatcttatggttactcgtaaatttcgccgtccttatcctccgattcttcctcctgccccttggttattcgcaaggtgaaaagctcatctacgcgacaggcgataagctgaatcgcattacggatgctgcaatcctgctgggggtcacggtcgtcggtgcgttaattccaacagtaatctccgccaatgtaccattggtcttcaaaaccggcaaagtcgtcctcaaggcacagacggttttggatcaaatcatgccgtcgctcgtaccagtagcattagtcgctttatgttactggctattaggcaaaaagagaatgaattcgacccgactgattgtgctagtgctgattcttgggatcgcgcttggcgcatttggtattatcggaaagtaagtcgtcataagtatcactgtctcagttatcaaaaaggcgcaagcaacgtgtttaatatcacgatgtttgcgcctttttactttccatgaaacaatttgctgcgttttttgtggtggtcgtcattgacttaagctaaagtttctttacttcccacaattttaactcgtcaatgaatttaccgactgacgatctgctcatgtaaggcaacaatctcgcccgccaaatcccggaaagtaatcgccgtcatcacatggtcctgtccatgcaccatcagtaacgataccggttgatgttcgccgcttgcctcagcggttagcatgccggtttgtgcttggtgtgcctccgccagaaattgatcggcttctttgagtttggtttcagcttgagtaaaatcaccagctttggcagctctaattgcttcaaccgctgccccttttgcattgccgcctgccatgattaactgcatgacgacaagttgttgttgttcatccataaaagcgtccccccttaatagccttgagcgccagcactgtctcgatgtcctgcaagcaaattgttgacgccttttcggcctgtttatgccatcaaatcaaacgctgtttgtagaacatgatcgcctttcatcaggccgtaatcttgcatattaatgaccgctactggaatcgtcagcgtctttttaaagtcactttctaagtaacgcacttgcggcccaagcagcaacacatcagggtgctcagctgctaattgatcctgagcatcggaagctgatgcggcaaatattttgacatgaacatctgtctgctcagcagcatccagcatttttctaaccaacatactggtcgacatacctgctgcacaaaccagcatgatcgtcttctcattttcagccatgattcttttcctcactttcaaatggacgcaacgttggcgccaccagtccagtcgccgccacctgactaaaccagtgacctgattttttgagtgactttgtttgattgcgtaaatcattacgaatcaaaccgtaccgattcttgtaagcattcagccatgaccagcggtcaatgccggtccacacgaagtagccatgacaattagccccttctgcgatagcctggcttaagaatcgcaggtgatcggtcataaactgaatgcgataatcgtcttggaccataccgtctttcaaaaaccgttcttcgtttgctacccctataccattttcagccacaaaccaaggcagattgtcgtagcgacgcttaatggtcattgcaatgtcatataatgcgtctgggtatatttcccagcctttatccaaattcatttttcggcctggcatgtcgtaattgtcaaaatagatgtcaggcaaccacgcttgtaagctatctggtgaaacagccggggcttgcacccggaacggatggtagtagttaaccccaagtacatcaatccggttggcagcgatcaccgccaattcgtctgatgttgcttcccataaaacgccatcttgtttgagtcgcgcgaccaattcttctggaaaacgtccgtgaatagctggctctaaataaagatcattcgcccactgttccgcaaatcgcgccgcagctaagtcctcaggtgcttgcgaggccggataaaccggtgtcagattaacaattgtgccaatcgttccttgcggctgccgattgatctgccgaaacgccgccacagctttggcgctagctaagttcaggttgtacgcagcttgcacagccatccgcccatcgacaatattaggatagtgaaactgatataagtattggccgtcaacgatgactttaggttcattaaaggtaaaccaatgcgtcacctgatcgctatacagttcaaaacaacgcgtggcaaatttcacatagagatcgaccacatgctttgactgccagccgccatattgatgttgtaacgtcactggcaagtcaaaatgatgcagattcacatacggcgtgataccaagttgatgcatagtcttaaaaactcggcgataataatcggcccctactggatccaccgtgcctgcttcaagatcgtcaatcaggcgtgtccactgaatcgagattcgtaatgcctgcacgcctgcttgcttcaacaaagcaagatcgttttcataatcgttgtagaagttcgaggcaacatccggaccaacgttgtggtagaagtcttgtggccgagtatggtaatgataatcaaaaatgttttcgtgctttttatgaaaagtgccttctgcctgcggaccgctggttgccgctccccagacaaagtcagcatcaaattgaatgttcatgtcttagcctaaatgcgcttgccagacgagaagctagtctgacttgcgctcctttctatactcgatttctgatgtcagcggctgcgttgatgctgttgaaaattaaatgcggcgccgtataaattggcttcagcctgaaacttggcaatgcgaacgattggccgaatgggggcaatttcgacttttgccatcacaacatcgagcgcctgattcaaatctgcaagcaagtcagaattttgggaaatgccaccgccaatgacaaaacaatctggatcaagactgtactgcaaattgaaaatggttgtcgccagcacctgtagcatgtcacgaacggctttctgggctaatggctgtccggttttggccagttcgtaaagggctttcccgtccaaatcagtgccatttgcccggttgtagcgatcagccgcgttcacaatggtaccaagatgactgaccgtgtcgtcattgccgtacaacatatagccaaactcgccgcctaacagatgtcgaccacgatgaatccggccatccaaaacgacagcaccgccaaccccagtgcctaacaccagaaaaatgacgtcacgaacatctgttgctgaaccggcctgaacttctgccagtgcggcgcaattggcatcattttcgatggtgacaggcagctggaaacgtttggtcaattcagccacaattggaaaatggtgaatatacggaaccgcactggcaccgcggatgatgccggcagtttgatccactgaaccgggactgctgatagccacaccggtaatggttgctttacgctgcaattcacgaacctgagtttgaagtgtttggtaaaacaagcccaaggtctgcggcgttttgacactggtttggtgggagatgccaggcacctcatcgtaacaaccgaatttaagggttgtgccgccaatatcaataactgctaaactcacagcgccacttccttttcttgatcacgcacgtagtccaacgccaattgacaataagtcatgtttgcccacgaaaaccacgttcgcgtgaactgtgtaggatcgtctttgtgcacgccttcatgacattggccagtaccggctgttgtggcagcaatcgtggcaagttttgctgacttaacaggttcacttttagccaccagcccttccatcgccactgcaatcggccaaacatattccggtggggtgtgctcgctaccaatacctgccaaagcttctccttggtagtagtatggattttgtctactcaaaataaaggttttggttgccaagtaaatcggatcgtcagctgcaatggcccccagaaaaggtaaactcaacaaacttggaacattcgcatcatccatgaaacgtgtcctgccaaggccatccacttcatacgccaaaccttgatccccgctcggcaacgtttgaatcgcatacttagcaatgcctcgctcaattgctgtcaccaaagtttgtgctcgtgcagccaaggactggtgattggccggaatcagcggcaacaagcctttcaaaaccgtttttgcaaacaaattggctggaatatggtacccatattcacaccggttatcactcggccggaagccatcccagatgagcccagtataagcaacaggggtgccataaccgttatttggcaaagtatcgttagctgcagtgtcacgccggcggaaaaaatatggtgactgttcatgatgctgttcctgttcaaaaatatctaaaatgaccgcgaatgtttcccaaaaagttgcatcaagcagcgctgcatcgcctgtttcagtatgcaaccgcaacgccaacagtaacggtgcacatagcgtatcaatttcgaacttgcgctcccagacttgtggtgaaaccgaaatattggtttcatcgtcatcgcgccaatgagccgcattggccgtctgattaaaggcattggcatacggatcaagctgcacgaacgccaattctcgtcgtaggacaccttcaagaatcggctttaaatcaggcacgtctttgatgagttgtacataaggcaacacttgaaaggttgcgtctcgtagccacatcgccggaatatcgccggtcgcaacaaagtaggtcccatccgcctgccgacttgtggccttcatcagcgcatccggcagtaaggtgcgaaacatttgctgagccggggcatctggtaatggatgctcatcagcaaaagcagtaagtgccgctgctaacggtcggctgtcttcagtcataacgactcctttttcgatgctaagctgatgtgtcgcggatagataccgtacgtccgaatctctcccggcttaaaggctggcagcttaaatgtggtgacatcggtggcaagcgtttgcttcgtttcatgattgagattcaattgacgaatacttgccgcaacttcaaggataaagtctcctgctgttgccacagtgacatcggtcgggttataaacgcgaactaggtagccggcatggtcaggcgtttcactgacactcgacacaaccagatcgcgactcaccagttgcacaggtgactgatgcactaggtttgtctgattagtgttgatcgggaagtattgcaaaggcgtggtgaaacgatccaacgtctgtgtttgatagccaaggctgccaattgccaacgactgaacccgtcgttgcaattccgccgggacaaaatcagcatcaaggcaaatcccgccttgcatttgccgggtccctaaaagttgactatcaggcgtcggcacatacttggtctgcaggccagaggcatcaccaggccgccgttttaagtcaggtcggccaaggtacccgacaccgcggaacatagtaacggctaactggtcaaattgatcaccaatcaactgaaattctttttcgcctaatcctaagaaggtccagctcgttttgtcatcgtgcgtattggcaaaatgaatgagcggccgcaatgccgtcggttcttcatgataaccaatggcgcgccaatctttaagatgtggatcaatcaccggacgagcggcaactccgaatggcgtatcggcaaaactcgtctgtgcttgcaccggtgtcttcaaaattaaacggagtcgatgatcacaaacggtgttttcaacggtaaattcaaaatgaatcaccggatcatcagcggccaacttcaagaccaacatatacggcatctcgacactggcctttttggctgcacgttgagctagatcacttggcaactgccattgaccacgaaagacaagttcgcttaccagtttcccttgctgacccgtgacctcggcttcagccagcgtcaagtccagcagccagtcttgaaaagccggcgagtagtcataggtatcaccttcatcaccgccatcatcaaaatgaatcgggttcacaaacgattgcttcgtgcgtcgatcaaccaacaccagctggcccttgtcgaatgtcagcgtgtaataggcgttgctaatcgttgtgctcggctgacgatccgttacgcactggcttgcttcctcaagcgtgaagcccacccaatccatcgccttcattgtcaatggcacgacaatcgttgtccgataataaacatcaggtttttcctgtgctggatcgcgccgcaaaacggcgttatcaactttcacctgttttaagatttcatacgtgacaacttcaccattttcatctttaagtgaaaaatgcttgccacgcgttgccagcgtgatctcaccattttgatgaacgggccgcaccgttggattccagaaaaagacatttagcgatgccggtgctccgctagccagtttgcgtaaaagataatcgcggactgattctgccagttgtagcgccgcaacaccgcgttggtaaatatcttgattcgtcgcatctgaattgcagccgcctgatgaatcatgtgcttggccacgggcgatggcacgccagatatgagccaccatcccatcttgcgcttcgatgccttgatgagccgcaatcaccatcatcggttcaaccacatcgaccatcaaatgctcaagccgatcgtacaaatgctttaaatctgctcgcgatgaataaatgccgcgatgaattttcgatgctgacggatcaatgaactcgccttgataggttggcaaattagaacttgttgataaagctttgaaaaaatccggatagttgtcttccaccaattcaaagtcggacgtctgctgattggcgtactgaagtcgatccttcaagttaaagtcgactgctcgttgatcaccacccactggcagcgctaagtcatgtgcttgcgtatctgtggcaatccggtgtagcaaagccgccgtatcatcgttttcaattaggtcaacgcctgcatagtagccattcttgatattagccgctagaacttttgagccatcattagccgtccagtagaagtaacgggcattcttttcatgcggcatcccgcgccaaaagacagtggcggtaatgtcaaaaccttgataaatcttcggcatatcctgtccttgaccaaatgagtcaggcagatagccaactttcatgacgccacccaagtcagccgctaatttgtggccaagctgcaaattgcgaacgatggcttcaccactcgttaccatctcgtcaatttgagtgtaccaagggccaatgaaaagccgccgtgctttgacaaagcgcatcatggctgctcgtttatccgggtttgtctgcagataatcgtcgacaatcgccaattgcccatctaaaaggtaactatccagctgattatcggcgagtgcctgtaagacttctgccatgtgataggcaaattgaacccgtgcttgctggcgcgtgaaataccattcgaaatcccaatgtgtatgggcaataacatgaactttctgcatcaaataaacttctttctattctttatcgctcgttaagtttgcaactcattaagctgctgccatttgtcgctcgttgcgttgattcataatgacaaacggtgcgtaaaggaaaacatcaaagatcactaataccaaggcgagaatgacgggactcatatgcaagccgccaagaatccaggtactaaagaagatcggttcattacccgagttaagtaccaccagcggcacaacccaaccgattgacgtcactacataagccacaatggcattaaacagcggtacgacaatccaaggaatgaacatgatcggattcaaaacaattggcagtccgaagatcaccggttcattaataccgaagcaacctggcaccagcgccaattttgcaacttcgcgctccttttcgccttttttagcgaaaatcaacatggcaatgatgaggccaaaagtagcaccggaaccgccaatcatggcgtacacattcgtcatggtgttaggcgcgatcgaaatatcggcaaaacttttggtttcagcaaacttagcaacattttgtaagaatagcggtaaccagaaggccgatacgatcccccaaacaatgttgaaaccgtgcaagccaaggaaccacagaatttgttctagtaagatgacaacaatgatagctggtaatcctgtacccacagttaacagcggcttaatcacgaccgtcgcgatcaattgaattaagcttgcataccccatcgcctgcagcccaattcgagcaagcccaaagagcaacaacacttctgccattggaattaaggcaaaaaatgaatcaaaaacattttgtgggacgctgccgggcattttgatcgtgaatttggaacggctaaatgccgcgaaaagggcaacagccaacattccgacaatcaagccggtaaacatcccttcataactaaaaagtgatgacgcgaagccttcaatcaccttcgccttaggatcggcaaagttcacattgttgggtaccatcacaaaatatgcagagaaggctaacaatgtggcgataataatgttcatactcttgttttcgtcacgctgttttaattcaaccgcgtaggaataggcgcttgagatcacgacaatcaaaccaacgatgccaagggttgcgacgcctaaataaccgaataaattgctaatacttgtcaaccaaccccagtgaagattttgagacttaatcaaggcatccaactgcatcttgattaagttagaaaaagacccaatcactgtaaacggaatcgttcgaacaaaggcgttcttgaccgcctgtaaaatcgtgttgttttgaacccacattgatgctttaagcaacggttcttgaagcttatcaacattgaacttcatcattaaccacccctaagtagattttgttgggacaacgcgctgtgatattgtcagtttaaaggcgctttcatttttgtaaagacttatttttatcttgtgtatacaaattttgcgaaatagaaaaatgttaatatacaaatattcaaataattaacagaatgacatgtcaaatatctgacttgtgttacaattagtgaacaaataatccagctgaggtgacatcgttgtatctatattgggaaatctattccgacatcaaaaaagacatcctgacaaatcattatcgcgcaggcaaaccgctgccaactcaggaagttctcgccagaacctaccacacaagtcgtttgaccatcaaaaaagcccttcgtatgttgcaagatgaagggctaatctataccaaacaaggatcaggcagctttgtgcgcgctcaagcaccagacgacgacaaggaattgttgccgcttgatgcaccaattggcgtgacttattcgcatcgtgatcaaaaaatcaccagcaagctgctttattttgacgcccgcttaccaagcgcaactgagcaaaaaaatcttggcattaaaagtaatgaacctgtctacgatatcaaacgggttcgcctcgtgaacgggcatttttacagtctagaacacaccaccatgccgaccaacatcgcgccgcttgacaagaaaatcttgaagggctcgatttatgattaccttggcagtaagggcgttcagttaactgatgcccgacgcatcttgtatgccaccgaagctgatgaagaaactgccgaggcactccaaatcaaacaaggcagtccagtgctggttatcgagcagaccgcctatgatcaagaaggtcacgcatttgaatactcggtttcaagcttcatccgcgatcactcgcgattcgttttgaatatccatcgccgcttgccggatttaccgcattagtttggggccgtgcgcagtccctgaaactgtgatgactgacagccacgataaggaaaccgttctgcctgtatgcaaagggccgaattaaagcacttcttgccatgccaaactccgcaatctccggccagatggggtggcgacgcgaagctagagcggtgacggcgcttcgagcccaaagcccggtctcgaagtcgcctaataacatcagcgacaagcccggtcgctgtgttgtttgcacggctgagccccatctggcctacgattgctccgccttggcactgggatcctcgattctcgacaggtaatctatgagagaacaaaagccggacaaattttcctcgcatgggaaaatttgtccggctttctttaccagttttaacttgttctaatcttgtcttgctacattgtttaaattcagtttttaaccaccgctaggctttcaaaggttccttcaacataccatctgttgttttaccgcaggactgatagctttctaacaatcccagtttcatgaagaccgtctgttgataagcaatcttcgcattccattcaacggtttccagaatttctgtggcatgatgcaagtcttcggaagtgatcaaaacgccatggctgtttaagaggaagatgtgctcttttgccgcatctccgatttccttcaggccattgtagaccgtgtctgcaagttccttggagcaggctggtgcgtatggcagtacccgaatcggaccaacttcttcagtaacttcggtgacatttggcatatccaatccggctgttgcccagaacatggattcttcagcatgggaatgatagacacaacggatcttgtcgttggcccgataagcttcttcatgcatgttgatttcacgggtcagacgaccaacgccgtcaatcagtttgccggtttcaagatcaaccaccaaaatttgggttggttgcaacttggcataccaggcttcagacatcatggttggcgtcataatcagataatctttgccagctttaatatgaatatccccgtaatcaaaatccttgtcaggggtgatccgaacgctaatgttgccacctgcaacattggtattcttccgcatgaacatttcgcgggccacttcggctaaatctttccgctcattttcaaagacatattgttcggtcattttgaaattccttccttatttgtccgacgcgccaataactcttcccgtcttttttcaatcttttccttgcgtttgcgatcataatcgccaaacaaaattggattgactttgacgtaaaggatcacggtggcaattcccatcaagagacataaccatgtgttaccgcctagcaaagcaattgatatcccaatcgtatctaggaaaaccaagaatgatgctaaggttttactcacctttatcaccgcgtttcttatcatgactggtctgactgaaatccagtccgctaatgtcattcaaatcaacatcatcagctgtatcattttgcttatctttggcagccttctttgattcgttcgacgctttcgcatcgctgaagtccaaaccgctgagatcgctcagatcaacatcggtagcatcactgctggttgaagccggtgctgttggcgcagctgcggccgtgaccggcgctagtgcaccgtaacgttgactcggtaacttgatcttgatttgatcgcggtacaaccagatgaacccgagtgtccaaagcaccgccagcgcgattgcccaccactgaccattgaaagcttgcgcgaagaacaagcggaagtccggcccttcaaatgtggaccatgaaagctgctgaccagcctgaactttaacagtgccggttgatttggccaggttcgtgataactggtgcaaagtaagtggcaccatataagaagatcggcgtagtaatgatgcccaatgtgatcatccgcaacaggtttgcccccgtcagtaacaacgcagcgttaacaaaggacaagttgatgatgccagcgaatggcaagacggtgttgtgcggcaagatcatggcgaagaccaacatgatcggcactagaatgatcaccgtaacccacaattcgttacgcccggcaaggattggccagtcaaggccgatataaacctcacgacctttaaagtgtttctgcatgaagccgctcatcgcatcagcaattggtgataaggcggtcatgaaaagtttggagatcattgggaataaagtcatcgcagttgccgctttaatcgctaagttcaaggagccagaaacggaatacccggcaccaaagcctaatagcaccccaatcaaggcacccatgacggtattgtcaccccagacaccaattcgcttttgcaacgcatcagcgtcaaacggcttgttcataatcggaataaagtcaagcaacttattaagcggttgcaagatgaccgcgaataaggtgataaaatgcggtaccgtgacacctggcatgcctgtcaaatcctcaatatgccgttgccacatatcacctgctttcagttcgaaaacaatttgaatcccggcaactaagaatccgaagaaggcattgtgcgtaaagtacaaaacaacgacgtaagtgaaaatcttgttccaaacgttccacatatcaacgttcagggttttggtccagttgaacgtcaacatcacgaagttaatagctaataataacgggaaaaataggaacgcggacttgtacgaccaagtgatggcagcaaccccggtccagccggcatcaatcgcattcaggctcaaatggaagagcttggacatggattttgccgctggtgaaatagcctccatcatgtagttaacgaccaaggtcatgccggagaaagcaacccccaaggtcaaagcggccacaattgattttttgaacttcaacccggcaaccagacccagaatcaacatgatcaatggcacgaagaccggtccacccaaattcaggatataattaacgacgtcttttaagattgtcacgattttccacctcctctagtagaatgggctgttatttcccagcagcctgcatgttcttcaatgcttgaacaatttctttgtaggatttttcaggattcatgttcatgaaaatcggcatcccattcacaacagcgatgttattttccttggccagttcctccaactgttgattcggtttagcgatccagacatacacgtcatagttatgcaaaatttccggtaactgtttgaaatccgtcgcatcaaccgaaatgcctttaacgttattggtttcaaaaaaatctttgattcgactagcggttgcttcgctggaagctacaccggaaccacatgcaacaacaattttagccataatagtttgctccttattttgattggatcagttatttgttagcagcttgtgtcttgaacgtatcgacaaagaattgatacattgcttcaggatcagtcgttgccttgaacttggcgacaaacgctttgtcttgcaacagatccatgaaaacctgcaataacccgacttgttgactggcatcggtaatccccaagaaaaacatcgccgttgcatcctcaggctcgttgtaacccatttgcagtactcgaactggctgagcatttttgacgatggccataaacggctcattcacgttctcaggatcggcatgcggtaacatgaccgagatctcaggaaaaacaaccccagtcgggaactcatcttcgcgtttgttaagggcagcttcataagtgtccctagcatacccagccgcgcgaatcttcttggcaacatctctaaacagtgtttttcgatcggcagcgttttcgttgagaaaaattaaatctttgtgaatcattgtgctatagtccatctttatatcacctcatcttttcgagtggccttagcatttggaactttttgaaccttttccttgtttccaaagctaatgataaagcgcttacagtcttttgtctacgctgtaaagtggaagtcatcaaggttgacaatggttcatgaaagcggttaaaatttgttcagatagattcataataattcataaattggaggtgttaactgtgtcacaaaaaccggctaagtttgaaagactaaatgacatcatcagaattttgcgtgaaacaccgcaaattagtgtggctgaactcagtcgacaaatattcacaagtaagtccaccttgcgtcgcgatttgattgagcttgaaaacactaacatcattcaacgccaatacgggatgattcagctcctgcaaggtaacaacattgaattcacctacgaaaagcgccgcaacgaaaatgcgcggctcaagcggattatcagtcatcaaattgctgacaagattcctagcaacgccgcctttttcattgacggcagttcaacttttttcagcttacctgaactgttgcacaatcaagtcggcctgcatgtgattacaaacaacgtcaacatggggctacaattcaattcactgaacaatatcgaaaccattatcattggcggtaaaatggccccacgatcggcttcgacccttggctcaacgaccatcgaggaaatccagagtttccatccggactttgcactgctctcgaccggctccatcgatgcaggcggcatttatgttgccgatccggaacaagcagctgtcaaagaagccatgattgccaatgccaagtgcgtcatcttcgggattgactcaaccaagtttgatcaaagcgactacattcgcatcacgaacatgaatcagattgatgaaatcatcacagataaaaagccaaatgcctcctatcaaaatctatttgaaaaaaatcatattctgctgacctatccgcatgagtatcgccaaacacctaaaaattgatttgctcatcaccataattaaaatcattttttccccagttcaaagctaagtcactcaagctgactattccaaatttcagttgcttagaaaccacgatcacgtacaaaaaaggcagttcaaaacgctcccaatcgcaccagtacgcgtgattgatgagacccacgctccgggaaaataagttaactaaaagactcatttagtcgcagtatttaaaaagaacctgcccgagcaatttttactcaggtaggttctttgtcatatttgttttctagccaccagcgaaaacgtcaacggaatttgtggcagatcagccggcatctgccaaccgtcctcttcctgattgaacgtcagcatcggcaatgcctgccaatcggtgatgcgctgctcccccagtgcttcaatcgttaaaccagccttcagtagcacactcgttatttcttgaaaatcatgtgcccagttgtggttgcgggtgtgttggattagccctttcgatcccgccgtgtacgaaccatctgaatcgtaagagatttcggccccgctgaaataattttgcgtgatggtaagcccgtcattatccagtgcgaacaaaagcgggtgattgtcacgtatcatgaaaaccccgtctggtgcaagtaatgccgcgattgaattagcccaatcttgcaaatctggcagccaagtaatggtacccgcactagtcacgatcacgtcaaacccctgagcttcattagccagcgcctttgcggcataacgcgcatcactttggacataagtaatatccgcgccggcttgcttggcaatgtcacgggcgtaatgtaatgaattcggcgaaaaatcaatgccatgaacatggactgcgcctaggcgccaccagctcaaagtgtcggtgccaatgtgactttgcagatgcaacagtcgctgacccttaaccgaatttgctggcaagtgcggcaagagtacttctaaatcgcgtttaactgtgccagtcacaccgtttggattgttaataaagccagcaatgtcaccataaccgccaccggcatggatgttggcgcggtcatcccaattgctgagattgtcttgaatatcgtgatttgttgacataaagttctcctttttgaggatgcaatttaaagtccgtatggtccttgtcatgatgggaatacctcagtggctgcggcttgttagtattaaaaatatctcatttgaagatgtgatgcaaaatatcaaccatgtgtgagctattttttcaattgcttgtcgctttaatgccaccctatcagcaaaaaaccaactaattttgaagattacgaaccaagtccatttaaatatcgcgtgccacgtaatcgtgaattcacgctaccgactgacgcacaataacttgaaattaataattgtttatgattacatttttacgtcattttcacttgggtaatggttatgaacctttatactgaaattgacgtcaaaaacgagcgcgcgtgaaccggtgcagttagaaaccggcgtataagcagacttgggcgtgatggctgctttttcatcattgcgaccaaaggcccttacgtgatggtttctgcgccagtgaacgcatttaaggaggcattcatatgcataaaagttggtggcaagaggctgttgtttatcaagtgtacccacgcagttttcaagacagtaacaatgatggcattggtgatctaaccggggttgtcgagcacctagtttacatcaaacagcttggtgttgatgttatttggctcaacccaatttataaatcacctaatgccgataacggctatgacattgctgattacgaaaaaattatggcggagtttggcacgatggcggacttcaagcatttgctaaacgaagcacatgcacgtggcttgaaagtcatgatggatttagtagttaatcatacttctgatgagcatccgtggtttcaggctggcaagcaaagtcgcaccgatcctcaccatgactggtatatttggcgcgatccagttgacggtcatgaaccgaccaactggcgggctgatttcggtggctctgcgtggacctatgtgccagaagtcggtcaatactacctgcatctttttgcgaccaagcaaccagatctcaattggacgaatcctgcagtacggaaagccgtgttcgacatgatgacatggtggtgcgagcaaggtatcgatggtttccgaatggacgtgatcaacctgatctcgaaacccgagcaattcactgatgatccttacatcgttgaacatcctaatggcagttcattgggattcattgcaaatggtccgcatgttcatgaatacctccgggaaatgaatcaaacggtgttgtcaaaatacgatctcatcacggttggtgaggcccccggtgtcacacctgttttggcagagaaatataccggctttgatcggcacgaactagagatggttttccagtttaagcatatgggtctggacgatgatccacagtttgggaaatggtccttgcatcggccaaagttgaccgatcttaagcgcgtgctttccgaatggcaaaccgacctgcacggaaaagcttggaatagtttgtattgggacaatcatgaccaaccacgagccgtctcgcgttttggtgatgatcgtccagccttccgagttcgctcagcgaaaatgctcgccgcaaccttgcacatgatggaagggacgccctacatataccaaggcgaagagctggggatgaccaatatcgatttttcctccattcacgattaccgtgaccttgatactttaaatgcttggcacgagctcgttgatcaacagcatgcactgacctctgaagacatgctgaaacggatccatcggcgctcgcgtgacaacgcccgcacaccaatgcaatgggatgccacgcaacatgcgggtttcacaaaaagtaccccttggatcaaggtcaatccaaactatcagaccatcaatgcagcggctgaattggcagatcctgattcagtctttttcttctatcaaaagctcaatcagctgcgcaagcaatacccagctctcattgtctatggtgattatgagttattggatccagacgactcagatgtctttatgtatcggcgttttaccgatgatcaagagttgctcgttatcaacaacttcaccgatcaggaacaatcccgcccaattagcacgcgcttgcctaaaaacgcacggctaatgatcagtaattatgctgacgatcgtggtgacgttttgcggccttatgaaacacgcagctatcttggcgaacggcgttaaagaaccaatattcaatatctgtgacaaaaactaaagcgtcattttaacgcaaaagtataacgatggtttggattagaactcactgcaccacctaacctcaagtaacaaggccaatcgctttaggtcaccacattggcctttatgagcagtcaaattttcaccttgtatgaataacacaatgaacatttcaacgtcacaatttcgtcacacctagtctgtagtattagcaatatagaaatgagccacccactcattcctacaaaccccaacccaactttttcatttttactcctccaaagtagaaatcgccagtcggcctcccaccggctggccaatacataagcaaacccgcgtatgaatgcgcgggtttttgtttggctttatttagcaataggcacaacttccctaggcagtttatatcattaagaacaggtattgtgagtttggaggggtattcgttttgaagaaaagaacatgggtgataacaatcataggtgtcgctattttattggtgattacatttggcgtcatactcattcagaaaaacgacgcagaacgccgattatcattagggcgctcaagagcatcaagtatatcgacatcaaaagtgaaagcgtcaaagtggcaagtctctgtttcggaagcacaaagcaccgcaaactcaaaattttatgcagataaaacgtcaaaagatgctgcagcttcatcagccatcgtcgcatctgaagcaaagagtaaagcagaatccgttaatcatgttgacttcgataagttgagcaaaattgaccaagcaaaagcggctatctattacggattaggcaacatgcaatattttaacgacaaaagcgtcagtaattaccccggagacgctgtttattcgagtagcggcgttgatgtggtctttgtaaaagatatgtccgcaggcattggcagtacaccttatttagtagcgcctcatctttctcaagtaagtgctgcagcaccagtattttcatacgtcgaactaggtatgcaagcagatggtcaccgacctgaaggattgacatatggaaaagttgatgataattcctccagctttgttatcgatccaagattacatgccattggtctttccttttcaacagtaaacgactggattaattcacatggaggtatggccgctgttcaaaaaatcaacatcaaccgttttattgactttgaccaagagtaatgccaattttgctagcaaacaactaaattgattctcgcaaatttagtatgcaaaccaaaatttaagggtgatgccaagggtgactcaaaaataaagagcaatagcttagtcctttttactagctgctcaaatctgctatttttctgtatttgaataacacaaagaccatctttgcttcacaatttcgtcacacctagcctgtagtattagcaacatagaaatgagccacccactcattcctacaaaccccaacccaactttttcatttttactcctccaaagtagaaatcgtcagccggcctcccaccgactggccaatacataggcagacccgcatgatttcgcgggtttttgtttgactttaattaacgatggataaaatgctcccacaaggcaattggcagtctttttgtctttcgaattggaccacgcctagttctttctgtgttgctttaccatactaaagtgagccaaatcatgtgtagcagatgataccaaaatgcctctgcaaagctgtttaggaacccgtcttgcatagccaatcatgaaagaccgttagcctttggccgggaatctatttaccgtgcatgggttgttctgtgttggtttttcgtgctaaaataagtaaataaagaggcgcgcctgcaggtaatagacacgcccctagcagagccgtttaagacggctggcattgaataacaatcaggaaaggccgttagacttcggccaaaaatctagtgacggtctttttgattgtcaagaattgcgcgaacaaggatcaccactgtgccaacgagtaacagtacaaaactgccaaacgctaacataatggttattgcatccgcaacggacaaccagacacctcccttcactggattttgtgcgtgactcataagcaccaactcctgtgattggatttgccaaccgtcattaacttctctgctgtcgctatcataccatacaattcgggtgaacgcttagagccgtaaaggttacaggcgttttttattttccggtttgagcaccttctcggacacatggacaatcaataaacattacaaataatgactatccttccacatcaccaacgaactgaggtcatgaaccgcaacagataccttggattgcctttccgataccgagataagcaaagaacccctttgtcttcctcacagcggtgccctttttacctttccgacccatttctacaagagtctatcattctggctggcaagtagttgtcgagatcaataatttttcctacttgttcgctacgtatttgcgccagccaataacgccaaagccacagacaattaacgctacgagcccaatgatcggcaaactgttcatcatcatctcgccagtttttggaaaagcctttgattgatctgtctctgaatgctgcttctttttgacgagcgtctctgacttcatcattttttcaggatcgggcttgtttggtgtaccgggtacatcgtccttcccatcaagtgcctctaacgcccttcgcaatgccgataccatgttattaaccgtgagttgatcagcaatttgattggttaataagctttgtgccttggcaagaatttgatcaaaagctgccttgttatctgaacttgccttaagatatttagccttctctttaaccgccagcgcttggtcaatgactgtctttaactcgcctttttgcacaggaatagttggcttggttgcctcaaaagctccaattgttggtctttcgaaattaattggtttccctgaaaaatcttgagtaatcggaaactttgcttgaatagctgcaggtgttagctccgccacgctgcggccagcattggcaacaggcgaacctgctatgggaataaagctgcccagcgattcaacagacatgctgcctgtattatgattgatcaggccactaggttttgctgttacatctcctaattgcggatcgacaaataagttgtcactcacatcaaccgcatcagtatgactctgatcaagtaatgcttgtgggtagaaaagattgtgatctaagttgccttctgcaaatagtggccgcttgtttccagcctgattaacaacaaatttaggggtattacctgctggtgcatagaccaagttattcacaaaacgaataccagtttggccattatttgaaaccattaaatttttcacagctttaccaacgataaaggtgttgttatgaaacaagggaaaaccagcaataccatcatttttccctgacaccacaaaaatcaggtgattgagcgcgggcgatggcaaatcgcttacatcattgacgctcaaattgtaccggaaaacattatctgtttgatggtcacccataaacaaagtgaaaccacccgaattatcatgggagtagttatattgatacacgcctttagatgcaaagccgtcaaagtcaaaagctgctccatcaagataatggttgggaatgccaaacacttcattatattgggccagattatattcaccacccataaaccacaatccagcaaagtttttgctcgcacctgattcgttcttagatccaggcatgctgttggctgcttctaccgtgttgtattccgcagtcccattctcgcttgaactgatgacaatgccatcaccggcactatttcgaatataattgttcctgaaggccgtatgtgcactcgctctaaaggaatattggtcccagcctccagggaggactgacgcattggcatcattacgtaatccttcatttgaaacatccgtaatcacgttattctcaacagtgacgtctgtattgccaacgataataatcccgccagagtttttgccagatggcaccatttttcccgtctgatctggaactggatcactttgataggcaccgtcgacatgatgaacattgttgtttctaatattaataccggtacgatgtgaggctttgaaaatcgctagcttctgttgaagagacgcagcatctgtcccacttggatatggtacattgatatccgacgctaccaaaataccaattcgcatcgcttgacgattgccatcattcgaaaaattggtcacctctatattcgagatcgtccaatgattcgcattccaaagttcaacagcccccgtcattaaattgatattacttaaattacggtgatggtatggactttgattcgcagttgttcccataccattaatgattgctttttttctgacatccccttggtgatagctgccgataacgattggctcggaagcggaaccttcaccattcttagtgccatcaagaatgagttgaccattccagataccattagcgtcaaatagaatttgatctcctggttgaaatttcgtggccatcacttttgctaatgatcgccacggatgatcaacggacatgccatcgttgttgtcattgccattgttggcaatataaaagattcgattttcagcagcgctcagtcgatttactttgccactagccgccacaaatagcccaacggacaatgccaacaaaaccagcaaaccaacgcggattgtctttgatgtcttcatcatactccccctcatagcgttatctttttaactcagcttttgttttgacaaggctgctttgtttacctgaaaaacagcacgagcagcttttttggccaaattagcatttagccttctttccaacaacttgactgctacatcttcctttaccgttgaaaaatcataataaccgccattggtaacagtaattggtctaacaaggctcatggtttcgttagatgtccatgcaataaaaatgatgccttgctgaacgtcaccactgttagatgcacgtaagtagttaccgtagtacttatccttatcatgactcgaatcggccatcacgaatgttcctgaaaaaccttttgacgcaaaatcattttgaatggttgataaatcgctacttttgccactgacttgctgtaccaaagccgtgaatctacccagatcattgatcttttctcgttcaaaggttaatgcctggtagttaactaagttgggctttccccaatacttatccttattttgagaatagaaattttccaattgttttgaagtgattgtttgccgatatttctttgcatactgagatctgagtctcatcatcagggcgctgtgtgttttttgcgctgcagccatgccagaaagacttgctcccgtttgatcagctttcttcaaatctgtgaaagctaccaatggcttttttatcagaccagccgtcacaagcgccttgtcctcaacaatatattgtttaagtgtcctcaatgccttgtcttgtgcaaactgctgtggtgtctttgaaccatacttcgtcagccagaagtgctcgttatatgttgtgtgatacttcgtcatatagtgactcactgtgctggctttttcgttctgcaagaaatattgatagaccctttgcgaaacaggaacaccggcaacttctaagaaagacagcgtgtcttttgcctggcaacctgcaagcatgaagaccaacgtcagtaatccgattagcaatttgttaacctttttcgttgtcatcacctcaactagttgtacgaacctcactatctcagcattttgcttgatccttttaacaactcgttttcactacaaaagctgaaagtgcttttccactcgttgaccctttcgcttaaaaagattgaagctcccataagcctcagtcccatcaaaccaatacagcttgcgaccaacaatcgtattctctgactgtagcgtcaccaaataattcacatcatgacccagatcaacccgaaatcctgttgctaaccggtcatcaacgatctcatcatcgttaccagaatggcgcacttggaccggcgttaccgctatgtcaggattagccggtgaaaaaattgcagcttgtgcggtaaaatctttgaatagcgtttcagattccaaacgtgtcagatgatcaagggcattgtatcgtggtgagaacaactgccagctcttccatatatttctctcagtaacagcaaggctagctacgttgcctaactgatacccttccgcttgcttagtcactgtcaggtcaggcgcaatctgccagaaacgtttaagcgtgtgatagccagggtcgctaacaacgtccagtatcagccgcaatctctcctccgcaagattgattaaatatctgacaaccatcactggtgtttgctgggcacgatcaatatacactgccttaatcagctggccggcgctaaaatcaatcacctgattcgtaacaggtgtggcagcatactgatacttccatgagtcctttggcaaactgaaaggcttgtgatccagcatcacagtgttatgagcttcaacggatttcagataacggcgttcggtgccatcaacgtacgtatatcggccgccatcgacaagcacgtcatgcccgtccatcaccaaatcaaggtgccccaaggccgcatgaccatgaccgctgccaagattgccattgaataagtgccaataatcagcgttttcaccccagtctgagcgccaaaagtaattgccgctgatcggtgcggcatattgcttagtaagttcggcttttttggctgctggttgccacgcttgatgcgccagttctaataaaacaaagtcgaaaactggttctaatcgatcttgcaactgtgctggctgacttaagatagcggcggagctgttgaacaagctgtcaatccgaatggcatcggtatcaccttgctgtagcaatgtcagatcgggtttgacatattgcgccatcatccgctgcatggcacgggttttttgtaaaatattcggggccaccgtctgttttgctcgttgctgagcagcaatgaccgccaacgaactgcgccaaacttctaacaaatatagcggcgattgttcccactgcatgccttgcgtgtccacttgaagatccagttctacctcaaatcgctgttgcgcccaggtaaccgtgtcgcgatcaacgacgtcagggaatcttgccgcatacgttaaaatacctgacgtgattaagatgccccagttactgatatcaaacttttctgtgtagttttggcggagatagtcagcctgaaccttcaccgcatcatgaacagaaactgactccgatgcatttaattgctcactttccaccagattggcgacaacggatgtccaatttaataatcgaatgcctgtgtcaattgttcgccatgtttcgggcaacgccaaattttgaccgatccaagaaaaaagaagggctttcatttttgtttgatatttaacttgaccagtcgtatagaaagcttccaaaagatccaaaaggtactcttggcgttttaacatgtacagccattcaggatcgccattaggcgtctcttgccatttaattggatccatagtatagctgatttgagtgggttccatcgcataaggactatcgaacaaaaaagtattatctaatagccgatctgcattcgtctttgcgtctttagtgagatgttgttgctgcgctagttgctgaatgtaccttgcccaacgctgctttgtcatgccctgacacctccttcaccactccagcaattcccatccgcttaaccgttatcactgtcttttcagcgatttcaacctgaacatcttcttgattcaagctttgtatgttacctaagatgccatcaatcaggacaatttgatcgcctatttgtaaattagcgtgcatctgatcaacagcatcagcttgtttttgcatggcatgacgttttgccagaggaatggcaaccaaataaagcaggcaaacaaggacgaccatgatagctaaaataatttgccagaaggtcatcagataccatccccttcatcttgatgtgtcatatccggaaccggcgccgttgctgaatttgtgttcatcctgtcgggcagaatctcaatcagttgtttcgaaagcgtcaaggtgtgctgcagctcaccttcaatcgtgtcatcttcaaacccagtcaagctcttggcatacaaatctagcatcaaattgagtggtgcacttgagatcacatattgatgtggccgattgccttcgagaaccaaacgcgacacaatctgatgcggcgcaccaccagtcatgtcggcaaaaactaaaacccgttcatgctcactgagcaactcggttaattgtttttcgaatttttcatgcgttgtttgttcatctaagttaaatgccttgatcccttcagttgtaccgatcagtaactggagggcagacaagacaccatccggatagcggccatgacccacgatcactatttcataattcataaatgttgactccttttttagttattcggtcgtcaatgaaatgttgatatttcttgtttttacctactcctgaaaatagccgtctacacattatgtgacggctgtttggtatgagcatttcacttcaagatgcctaaaacggagagcaggacaccggcaacaaatagcagaatgacaattttataaattgtccacttcttctttgtgatcagccaataaacaaaatacgtcagagcaattggcaacataaacggcatgattttgtcgagaatcgtttgaacggccacaacctgtgttttccctttgataacttgggagtattgccatgccaaattcacttttacaaaggacacagacaagccagcaataacggttagccccaacatgctcgcaacatcagcaatggcagccatccgatcagatagtgtatcaatgatgctcgtgccgactttccagccgaggtagcccattagcatacgaacgccgaaagtaataccaaacagacacaagataaacggaattggcgcccaagtcatgccctgcaatgcaagtgacgcaaagattgagctgaataacggtgccagtccaaactgcgacaaggcatctccaatcccagctaacggtcccatcaacgcgaacttgatcgcgcggacgtcgtcttcatcttgaccactatcatacatggccaacataatactgctcacaaatggataaggttgcggattggtattgtaaaattctaagttagacgttgttacccgtttaaattcagcttcatcatttttatagatctttcgcagttgtggcatgatgctattggccatcccagttccttgcatcgtgccgtaattttgtccattttgcagaacataagatcgcaaaatggagtttaagtaatcttttttggttaaaaccggcttccgactagatgccatcttcaatacccccttcatccccgtcactaccaagatcatttgtgctggtactgccgcctttgttcttgtctgcccgccgaccattatagtaattgttgaaagccagaacggcacccgcgaaggctaaaccaataaccggcatcttgagataagccacacagacatacccaagaatcaaggccggaatatattccttcttagccattgtgctcataatcagcgcaaacccgacagcaggaagcaacccacccgcaaccgttaaaccgctaattagccattgtggaattgcctgaacaaaaactttcaaagcacttgtacttaaggtagccgcaaagccaaaacagaaggcaaacaagatgaaccctaataatgttgtgtttgccaaaaagtggaatttacgatactttccctcttcaattgcttttcttgaccacgccaggttgttggcgttgaccgagaaaataaacgtaatcacaaatggaatcaaaattgcaaatggatatgatagcgataacgccgcagctggtttaagtccgctgattgagatcgccatgattgtaccaaccacacctggtcccaatggattaggtggtgtagaaccaccgggaccgacgccgaatcccataaacgccaattcggcagtggctccaaaaacaacagctgtttgcaagtcacctaggatcaatccgatgccaaatgagataaataatgcccgattagtataaatgccccattgctggccggcaaaacagaaagccgcccacaggcctaccaaaagcgcctgaacgatagaatatgtcatgctctttcctccctaaacgtaaacgcgttcgcaggcgcaggaacctgcacataataaggacccccaagcctaaatgaccaaagcccagccttttaggcttggggccacttaggctccggtttctaaccgcgcctgctcgcgctcttcaaatatcagtgtgtcgcaacataatcatttaaatcgaaatccgagccaacatcattgccaagcggtgttgtgcgggtgttcaaatttgcgtgatatttttcatgcaatgttcttaaagcattgagatcatccgcatcaactgaaataaaattcgttaagcgcgtcttaccatctttcatatggatattccccacatttagggccttaatcggcacaccgccttcagccagcttcaaggcatcttgcggggttttaacaatgatgaaaattgtttgccgcggcgctgctttgaaaatcttatcaatcgtttccgccagtgagaagaaacgaatgcccactgattctggcatcagtgaagccatcaattgttgttgaatatgactcttcgcaacctcgtcatttgcaacaatgacaaggttcacaccaagattcgaaatccataaacgcccttgtccgtgaatgagccgctcgtctaagcgaactgccttaatgtttggttctgccatcaacatttccctccataacgcgctattcagtctagaaactgactggcttgcgctctgtctaaacgcgttcacctgcccaaaaaccggattggttcacgctcaccaatataattgccaatctttataaaatctgatcaatgcttccatgtaaaaatagtctccccagagattgccttcatcaacaccatggttggaatgccaagagtaaacgccgtggcgtaataacggttcaacggcctgaccgtccacgggcatcgcatatttttgaatcaacgactttaactgagcatgcatggccacttgataaacagatttatcaggatcagcttctggcaaatacttcaacatttcatgcatgccgcacacggcaatcgccgccgaagaagaatcacgactttgaccgctgcctgcttgaaataggagatcccaataaggtacatgatcaggtggcaatcgattcaagaaaaagtgggtgaccgctttgaacgtctgaaaggcgccgttgtcgtgcgtatcgtaataatgcaacgcggtgccataaatcgcccatgcctgtcctcgtgcccaagccgaatcatccgaatatccctgacgtgtcgcaccgcgaacaggttcgcctaagtcattgaagaaatatgtgtgaaaagttgaaccgtctggccgaaaaacagtctgtaaagcggtttcataatgtcggtcagcgatttgctgatattgatgattacccgtgactcgagttgcccaataaagtaatggaatattgagcaaggcatcaacaatcaaccgattttcgtctttagcgcctttttgtccccacgcctgaataaaaccgcctttatcattaaatcgcgtcaataattgatcggccgctttgatacccgcttctttagctagttggctccctgtcaattgataggcacttacaacggatggcgagcataagaagcctaggtcatggtgatcaacagcgattcgctggtcaattcggtttgcaaaactttgaacatttttctcggcaagcgcacgatattggtccttacctgtatattcgtaagctagccaaagcatccccgtccaaaagccattcgtccattccgtgtttggcatagcggcatagcgctcttggactgtggaaggctccggaaagctttcacccaacacctttatgttcaagtcgaggtgccgaacaacattatctaaagcgttagtgaccgcatgaatgtcaactgcgccggcattaaagaaacgctgtgcattggttaaaggttcaattttcaatttgctatctcctcgacgagctcacaaccatacgcttctatttcgatcaacgccggaaacggtgaatcatcatccgctttaatcaaatccgacaattgaagctcgctgatcccttctttgttaatatcgaacatttgccgttgatctgttttagtaaagtgaagcagcatttgactgccgtctgagagtcgcaaggtgccttgtgtccaataactatcgtgaggaaaatccgcgcgtaatgtgatcgctaaacgcgttagcttgatcggacgcccaaatgtgagcgtgaaccttgccgttgggtcttgattgatcccccaagactgatacggaaattttccatgatgatcattgagccgataaccgtcaatggcattacgcgcggcaaaagttgggtcatgccttgtttcgatattggcacttgcatgtgggtaagcaccggaatgtacagcctgatcgtgactattaaacgccacattgcgttcttctgatacttcgctcgcatctggcttccagatgcgaatgagatgtgttttaccggcaaaagctgtttctggatagatactttcgtgctccggatgggtcacggcaagctcgtcagttggaatgacataatgccatgttgactgggtaaaataaagcaagctgggcaccaatgcggcatcgacttggacccagaagaaaccaggcagaagctgacgctcaaactcaacttgcacataatcaccctctgcatagacatgatcaaagcgcagataaccgtcaggctcaccgtttcgacttgtatcaatcacttgatccgacgccgaaagcaacgcaatttccaaaatagccccctcctttatttctttataggaaaccctgtttctttttgtttacgagtgtatcttaacgtgcattattttccctgtcaacaaaaaagtaaacgtattcacaagacgattatccataatgtcggattagtattgatttttttgctgattgtgactaaaatgatcagtagtttccaaataataaactcttacaactggagggatacgcatgggcaccacaacaaatgagtcaaaaccttatgggaccgtgctgattaaggctaaagatattttagatttcctacttgccactactgatccaccaaccttatctgacattagtcgcggactgcatgcttcgaaaccgaccattttaaagatcttaggaacacttgaatcgcttggctttgtttggcgggataccacgacaaaacaatattttctaggcacgcagtttgtgccatatgcgcagaaagcaattgccacttttaatattgtcagagtcgcacgtccttacctcgaagatttgcgggataagacgcaagaaaccattaacttagggattgtccgcgataataagatgatccttgttgaaaaattggaaagccccaccagcatcaagttgcaatcaactattggcggaagcatgaacatgtactcgtctgcaatgggaaaagccgttctagccacgtatgatgccaaggaactacaggcttacttcaagtctcacaaactcacgcccatgacaccgcatacgatcactacacccacaaaacttcagcaagatctaaaaacgattcaagagctcggtgtcgcgatcgataatgaggaaaacgaggaagaagtttattgtctcggtgctgcactacaaaaaaacggtgaactttatggtgccttcagcattagcacaccgaagtatcggcttcccaaggaacgtcgagctgcctttgtccgcttgctgttggacacacgccacgcaattgaaaataccctttaactttcaagatactttttgaaattgtttaccttacgcaatcaaaacaaacaggtcccagaaagacgttgcctcgtctctctggggcctgtttagtttgttcaatttcttctgattttttgttgaatcgattcttttcgttttggacactcacataaaaaatttgctttagtggcttgtgttctttttgaaaacgttttatattgatgaagtagcagaaaaggaaactatgtttctatataagaaatcacggaggggattattttggctttccacatggcaacacgatatgcgcacagtcccgaagacattaaacactttgatacaactaaattgcgccaagaatttttgatggagaagatttttaacgcgggtgatatcctgctcacctatacctataacgaccgaatgatctttgggggtgtggtccctactgaatcttcgctggaaatcaaattatcgaaagagctaggggttgatttcttcctgcaacgccgtgaacttggggttattaatattggtggcccgggatctattatcgttgatggcgataaagcagcaatggtgaagcaggatggttattacattggcatgggaaccaagcaggttgtctttgcatcagacaatcctgccaacccagcaaaattctatgttgtatccacgccggcccacaaaacttatcctaacaaaaagctgccatttgcaaatgcgcttgccaagccaatgggtgatcaacaacatctgaataagcggacgatctacaaatatattgacgcgtcacaaatggctacctgtcagctgcaaatgggctataccgttctcgaacccggctcatcttggaataccatgccagcccatacacatgcacgacgaatggaaacttatatgtattttgactttgccgaaccagacacccgtgtcttgcatctcttaggtgaaccaacggaaacccgacatatcacattattcaacgagcaagccgtcgttaaccctagctggtcgattcattgcggtgttggcacggccaactatgctttcatctgggcaatgtgtggcgaaaaccaaacctatgatgacatggatcaagtacccatgaatgaattacgttagcaacagataaccctatcaaaaaggagcaatacacatggctgaaattcatcaaactgaagaagaaatccggaaacacgagcaagaactggatcatttcaaaatgtcacaatttaatctcgcgggcaaggttgcgattgtcactggcggtaacactggtttaggccaaggttacgctgttgctatggcggaagctggcgctgatatctttatcccaacctttggcaaggccgagtgggacagcacgcggcgtttaattgaaaagcgtgggcgtaaagtcgcattcatggacgtcaatctcaccgcgccaggaagtgcagaagcagttgttgcagaagccatcaagcagatgggccatattgatatcttagtgaacaatgcggggatgattcgccgcaatccactacttgaatccaaagataaagattgggatcaagtgattgcgattaatttaagcagcgtctatcacttgtccttagcagtttcaaaggaatatgccaaacaacgatctggcaagatcatcaacatcggctccatgctctctttccaaggtggcaaatttattccttcttatgccgcaagcaaacacggcgtcgcaggtttaacgaaggcttttgcttcagaaatgggtgcgtataatgtccaaatcaatgcgattgctccaggctacattaaaacggaaaacaccgcaccgattcgcgcggacaaagcgcgtaacgatgaaattttggaacgaattccagctcgtcattgggcagaaccttacgaactaatgggcattgccgttttcttagcgagtgatgcttcaaactatatcaatggcgctattattccagttgacggtggttatttggttagctgaattcgttttgaaccattttttcggttaagtgtattgacttcgattatgacgtatcgtcctgcttgaagctcttttgcgaaaaacccatcctctggaaagaagaattcatcatgcaaaaatatgattttttgaatcggttaattgccactggctgtgttgccgttgttcgcggtgataacacccaaaccgccattaagacttgtgatgccgttattgctggcgggattaccggcattgaactaacttttacggtgccgcatgccaatgaagcgcttgagaccttaaccgaaaaatacgccggtcgtcaagatgtcgtcatcggtgcaggaaccgttcttgaccctgctactgcccgacttgccatcatcgctggtgccaaatttattgtgagtcccagttttaatcctgacgttgcaaaaatatgtaacctttacgctattccatatacccctggcgttttcaccccaaccgaaattcaaagtgcccttgaagtaggcgtcgatcttgtcaaaatttttcctggcagtgtcgccgggatcaatatggtgaaagctttacacggcccattcccgaacttagccatgatgccaaccggtggcgtttcattagcaaacatcactgactggtttgaagccggcgtgatgctggtgggtgctggttctaatctcgtagatggcgccagtcaaggcgactacgaaaaagtgaccgtcaccgcacaacaatatcgcgccaaaattgcccaaattaaggatacaaggagatgatggcatgccaacagtactgacactcggcgaaatgatgctgcgattaaagcccaccaatcaacaacgaatcctccaaacatcagcattcgcggctgattatggtggcgcagaggccaatgttgctgcgtcgctggctttacttggtgatcaagtacaatacctagattgcaataataaagttaccacctagaaagaggcttgctcactgcttgaactggggtttgccaacggagacattttctaggtttgttattgataaacgctgtggctcgttgaatattggcctctgaaacctgatcaaactgtgttcccttcgggaaatagtagcgaagttctcgattgaaccgttcgttcgtgccccgttcattcgggtgataggcatggcaaaagtaaatcggtatccgatagcgctttgtaagcgcctgatcgcaggaaaactctttaccgtgatcaaccgtcactgatcgaaccggacccggaaagtctaccatcagtcttgcaaatcctttgagaacagcattttgtgataagttttcaagcttagttgtcgccattaaacgtgtgacccgatcgacaatggtcaaaacagcagcctttgacccgcgaccaccgcgaactgtatccatctctaaatgtcctttttcggttcgccgattagctgacttactgcgcatctcaattgaggtgcctactgcttgattatagcgcgaccgaagatcttgttttcttttatgacgtttaccgtgatcaaagagttggcttggctgaaaatcgacttgtctttgataaatccagtggtaaatcgtatgtggcgcacagtgaacggcataaccgaccatttcaggggaccaacctaggtttagcttctcagttaccatccgcttcagcctaggcgtcaaaatcgagtgtcgaccacaacgatgccgacaagcattggcttgatcctgagctataatggcgcagtaatcaccttcagggcaacggtgaagctcatgcctaatagaaatacgagagcggcctaaggtcgcggcaatgtattgaatcgtgtggtgttgcagcagttctatctgagatcgttcaattaaagttataatggccatgggacctgtcctttcccctagatggtatgttatgcaaacaccattttagcaagaagagacaggtcttttttcacattttctgggtggtaactttaattatgcaatctaggaatatttaaccaaactccccgaaaattcgctgggaaacaccgcccgcaacacgattcgcggcctgggtgttgatacccagaaaatcctttggggtggtcctcgactgggcatctatttctttgaaaaaggtgcaagtgtacggaatacaaatgttgtctatgatcgcgcgggcagttcttttgccacgatgaaagcagacgaatttgactggccggttttgctaaacgatatcaactatttttatttttccggcattaccccagccatcgggtcagaacaacaagcggccgtttttgctgcctgccagtattgttccgatcacaacatcacggttatttgtgacatgaactttcgtgaaaaaatgtggtcccctgaagcagcccaagcattcttcaaaactgtcatgccatttattgatgtctgcattgccaacgatgaagactttgaagcaaccttgggcatcaaggcgtttgatgggaatatggcaaccggcattgaccagcttgcggattttagagaaggtatgctcgaagtaacccgacgatggccaaatgtccacacagtcgccagcgtcgttcgcaacattcattccgtcgaagaaagtcaatggaccgctctcctggttcaaaatgataaagtctaccaaggtcctacgtttgatatgcatatttttgagggcgttgcggctggcgatgcgtttggcgccggattagtccacgctctcattcatcattttgaaccacaacggaccattaactacgccatttcagcgagtgtcctaaagctgacaattggcggtgatctcaacttggtgacaaatgctgaagttgaggccagcatgaagactaatagcagagtcaatcgatagtgttttgcagtcattaaagaccggttagatttctggcagaagtctaccggtcttttttggtgcctaacgcacttcttcaagcagcttaccgatcaacgagctctacaaatacttactgccttcccgcattgccaatggactgagcgaatgggcagccataaatgcgagcacccaatctgggtcaaacttactatactgccgcaaagaccacccgatggccttctgaatgaaaaattcattcgtatccaaatcagccaagataaccttgctaagcagcgccgtatccatcgtttctttttctagcagttgtaaattaattccgatacgccgcagccaaaaattcggttgattaaaaaacaaattaaagactgccagtttctgatcagggtgcagcctcacgtagtccgcaaaaaccttacgccaagcatccactgtatcccaccagcttttctgcacaacaagttgtcgaaaagcctgcatatccgaaaagtgccagcgcttgatgtgataaagcgccaaatcaattgccacatattggtattcccgggcatcgcgttgatacaacgcatcaatccaaactcgaatcgttggtaagtcctcaccgcgactggctttaagcaacggtttcgtctgtgccttgcgttccggtgttttgagtcctaaaaatggaaattggttcttcatatacttcgccatttgcggcgcttgcgttggatcgccgtttagttcaaagtctaaagactgcatatgttttctccaaccatctacaaaaagtacgatgctctcgccaacgagaacatcgtactttttgaatgctatccacgatgtgcgtccaaaatctctgggccatgtgttgtgccaacgaccacggttttgaccaaatctaagaacaagccgtgctccacaataccgacctgcttattcagccattcagccagcagatgcgggtgctcgattttgcccagatgcaagtcaatgatatagttcttggaatctgtcaacgccttgctcccatcttcatttaagcggtatgccggtttaagtccttcgtcggccaaccgttgcaacagcttgccgctgccaaatgggatcacttcaagcggcagtggaaatttgccaagggtatcgaccaacttggtttcatccacgatccagatgttgcgggccgagttgatagcaacgatcttttcgattaagtgcgaccggccgccacccttgatgccctgaaagtgcttgtcgacttcatcggcgccatcaatcgtcaaatcaatttggccaacctcgtccagtgctttcattgggatgcccagcgattctgcttgtttacgcgtacgaacactggtggcgacaccggtgagattgagatgctcgtctttgattcgttgcgcaatcgcttcgaccaaataaaccactgtcgaacctgtccccaaaccaattgtcataccgtcttcaacaaactcagctactctttgcgcggcttcctgcttcaacttattctggtccatggcaaaccatccttttcgcttagttgctttcattataatatgaatcggtcgacagatggcgagttgtgtagaaaaagccaaattaatagatccgcaagtttgaccacgcggcatcctgcttgttggccgcacgcctttacccaaaaggtacaaaaggtcacgttggttgatacaaactcgtataaacaaacgatgccgtcgcgttcttgacgccattgacgaccaatggatactcagccaactgatatctctgggtgttcacaacatcgacttgctggccaatgccggaagtgtttttagccgtaattcgataatggcccgcagcaatattggtttcgagtttataaacagcagcagctggtttcagcttgtacactttgccagtacttagacttgtcagcgttaccttcatgccagcggcttggtgaatttgaactgataggtaatttgatgcaccgttcaagctgatttcttcggacatcactgtatttggtgcaattagttgcggctttgcatgatattgcgtggagagttgggaacgttgcgccgccacaacgatcgtattcggatagtccttcgctaacaaccccgaaaacgtgctcagcccaagaatagcggccaaagcaaatccaactgccaaccgattgcgcgtccgtttaggaatgacaacacgtttgcgcgccgtattaggcaaagctcctagggcaaaaagaacaagcggcacgatcgcctggccgtatctttcttcagtttcccataacaaggtatggaaggcgagatatccaagtgcggtgacaatcgccaacagtcctatcaaggcagtttcatcacgtaaatctggctgccatgccagcaaccgaatgattaacgtcaaccaaagcacaatcgtgacaacttgataactcacggccgtaactgctctcagaaattgtgaatgctgatcgtaccaagtcggcgccgattgaaatccgccattgtaccagtcttggatggatctgacattaaggagaatccctattttgacaagccaaagcttcattaatccaaagacgccgagcttcttaactcgagtttgaatcgtttgaatgtcgtattgctcaactgcctgtttatcttttaaggtaatcgctttttcaatatccttggtgctatacatcccgtcagagtttgtattcacgcccattagcatccaagacgtaaccggcagttcatacgcagcatttggatggaaattagccgcagtatgaatcacctgtgtcgttggcacgctcaggccgaaaccagcaacaatcaaaagaaaaggcacagtcaacttagtagttcttagaagttttcgatgccacaggatcacaacgatgatgaaaagtgctggcaagagaacaatcaaatttggttttagcaattgaccgactaagacaagcatcgtcaagccgatgccggcacaaattcgttgcaggttactcttgattcgccatcgccataagatccgaaaaatcatgagtaaaatgagcatagaaggcagatcggaataaaagacctgcaaatagtaagtgtacgcgaagggacttaagactaggaatgtaaagccgcctaacacgatgctattgcgctcgctcaattgtttcaaagttactaaggtcatgatgataaatgtatctaacaaagtgatggtcagtatatgactcgcaacgttcgttgacatccccaccaagctcgtcaacctgaaccaaagcgagagcaagtaggtcagcgaaacattgttgggataacgccagaagtaagtcgtgttccaaatgttgtggcctgccgccatttgatcagcctgtgacaaaattcggtacggatcatggtaaatcgtgtctggcagaaagatcagaatcaaaacttgccccacgagcatcagggttaaaccaattccgatcattatcctcatttgcctagcagtcaatcgattaaccaacggacctaagttgtgtgcagctgcgaaagtaacgacactgatgagcaggacaacggcaccccacaaaacagcaccagatttcattaaattgccgcaaatgccgataatcagacaaattgctaggaaaactgccatccatgaatgtttagccatttttgtcatttttatcacttctaatctaagcgggtttgaatcgtataccgcggtcgtcctttgacttcagtcatcattttaccaatatactcgccgatgacgcccagactcatcatctgcaaaccgcctagaaaccataaggaaaccatcaatgatgaccacccatgaacggtcaatccaaggactttcacgatgattgagtaaactgacatgccaaaagccagcatcacagcaagtgtccccagcagaagaattaaccgcactggcgcaatggtgagtgaggtaatgccgtcccaagcgaaagcaagcatttttttaagcggatacttcgactccccggcgagccgcggggtgcgtttataatagacttttgctgtttgaaagccaagcttcgggatcaatccgcgaatgaacatgtttcgctcaggataagtgagtaacgtctgcaccgctcgtttggacattagacgaaagtcagcatgattgggtaccatctgaacacctagtagtctgagcagtttgtaatagccttgtgctgtcgtacgtttaaaccagctatcagtttcacgatgggtgcgcacaccatagacaatatctgcaccggcactgtatgcctgaaccatctccatgatcttctcaggatcatcttgcaagtcagcatcaatggtaatggtcatgtttgtggtcttaatcgcttccgtcaacccagcgatgagtgcagcttgatgcccaaaattgcgtgaaaaacgtaatccgcggatttttaagtgctgcttatggaaactttcaatgattgaccaagtgttgtccgatgatccgtcatccacaatcagtatatctgaatcttcggaaaggaaattttgggtaaccacctctcgttcaattgaccataatctcggcacagtgtcttttagcacttcttgttcattataggctggtatcacaattgttaacttttgcatgctacttatcctccctttgcggacgaaatgctgaacgttgtgctgcctgtttgacaatcaaagcatcaatgtatcttgcttgcggcaacataacgaaccaaagaccatttgcgagtaacaagctgccaagaatatcagaagcaaaatgatcgcgcagataaatccgactggtagcgaccatgccaatccagatcatactgagtaagattgccacaaattgattttcttgttctttaatttttggcagcatcagcattaacagactcagcatcagtaccattgagcacatgacgtgaccgcttgggaaactaaaacctgtgtcggcaacaagttgatgtatcggtcgcagacgttgaaccagcaacttaattagtaagagaaggcctgatccaagtaattgacacgcaccaatccagatgctgtcggatcgtcttcccttgacccatagatagccgcagatcgcggcggtcaaactgatcacaacaggcgggctgcccaacagcgccaccacttcaaagatacgggtatccatttgtgtatcatatttgatgatgccctgaacactgcgatccagctcaccgacccacgctacctgcatcacaacagaccaagttatcaaggcaaacagcagcaataatccaccgcccaagaaatagtcttttttaatgttcatctgcagtcatcccccgttttcgtatggccatcacgatcatcgggaacaaggaaatgccgataattgcaagcatgatgagttcaaaatgtgctttaatgaatggcacatttccaaacaggtaccccgcgccagtgaccagtgtcacccagctaaagccgccaagaatgttgtaaatggcaaaatctcgataatgcatttttccgatcccagctgtaaaagggacaaaggttcgcacgaccggtatcaatcggcctaagaaaatcgcaatatgaccgtactttttgaagaatgtttgactgcgttgaagatacgctggtttcataactcgtttaaacttttggctggtggtcaagtaagcgccaaaatgttcgccaatttcaaaattcaaggcatcgccgaggactgcagcgccagtcaaaagtccgactaacaacccgtagttaatggcgccattacctaacgccgctagcgagccacaaaggaaaagtagcgagtcgccgggtaagaatgggaatatgacaacgccagtctcgataaagataacgccaaacaaaatgacgtcaatccaattaccggtgtgggctattaatgacggtatcagctgattaagattggggataaagcttgtgagtaaaagcaatgccatttgaaatgccccctttggttggtgtttgctaacagcatctagcttaatcgtctaatcggttcatcactacctagacaaaataaatcatttctaaattttttttagttttctccatgctattgccgagaatagcgacatctttccttaattttttgacgcaaatcattttgccaatcacgcaaaaacgccatctttttgcagatggcgtttcagctttcattcaattgatgccgttccttcgttgttgccagcggcaggataagttcggcaatcgttccatgaggttggttgtctcgcaacttgattctgccattgttgatcgtggcgagctggttagcaatagcgagcccaaggccagttccgggaaccgtgccccggacgttagcactacgataaaagcgctcaaagacatggcttttgtcttctgcactaatccccgcgccttgatcaagtactgccaatacagcattgccatcatcatcgcgcgtcaaattcaccgcaatgattgtatcagccggtgaatatttagcagcattcgtgacaaagttatccaaaatctgctcaatagccgactcattactttctacagacatattaggtgtcacgtgtacctcaatggtttgagaaaaagcactggccaatttttcagctaagtgttgaaccgtttcactcaggtttaacaaatgcgtatcaagcgttaacctgtcagcgcgtgatagctgcagcaattcttcaatcagctgttgcatctgtctggattcttcagtgatatagttgaccgatttgagcacaatttcaggatgcgcccgcccatgccgctcaatcagttgcgcgtgactgcgaatcgtcgcaatcggtgtccgcagttcgtgggccgcgttcatgataaacaacttttgctgttcttgccgatcatgcagttgtttcaaaaggtcattgaagtcctttgccagatcagtaacctccgtcggtttatctggcacaggcaacatcaccacaccagtctttgcgtgctccgctgcatgcttggtgctttgcgacaggtcactcaatggaccggtcaggcgatgtgccagtcgtcgaataaagatcggactgacgactaaggcaagtaccaaaacgatcatcgtgacaaccaaaactctgatcaggactgccagataactgttcatgctctgccagatctcataacggatacctttagcatgaacctcttggtagtagaacaatccttgattcgcttgatagcgcaactgcgtcaaaaacggaaatgatttcgccaattgaacttttttagtcgcaggcgagtaataatttttcaccttcgcatcttggcgcatattatgaacatgaacataagttgagctcgtatctaacgtgctgtttttgcgccaattttcccagtcatcatcaccgtcaatcacagtctgcttgaggcttgcagcaatatgatctgttgataataccacttgctcataaagctgatggccaactgccgccacgataagcagacctagcgcaagggtcagcgtggccaccatactgactaacgaccgctgcatgatcgcagcacttgattgattctgctttctctttttcaatcaatcatcgcctcactaaatggatgcaacattagccgagagcatatagccgacgccgcgaacagtatgaatgagtttcttgctacctgaatgatcatcaattttatgacgtaagtttctgatatagacatccaatatattaggttgaccgtcaaaatcggttccccagacggcagcaagcaagtcatccctcgaacaagcttcgtcctgatgggcaacaagttcgacaagcaactcatattcccgctgtgtcaatggcataatcacctcaccgcgctgaacgcgtttgttatccgtatccaccagcagatcatcgacttgaaaaatagtcgctggtgagacagcctgccgattgtgacgcaaggcgacttcgacacgagcaaccagttcctccatttcaaaaggcttggtgatgtaatcatcggccccgccagtcagtccagccaccttgtcgccgatgtaatcacgagccgtcaacataataataggcacccggctggattgtctgattttccgcaaaacactaaacccgtctagtttaggcagcatccaatccaaaataatgacattgattttaccttcattgttcttaaacagcgtcaatgcctccgcgccgtcttttgcccaaataactgacatattctctaactcgaactctgttgttaatgaatccgccagagccgcttcatcttccaccagaagcaatgttgttttcaactgatttcctcctaacgcggtcatttgaattataagcgcaagtacaggagaattgacactgctttttctataaccaaaaactaccatcaattttgcttttggttcatagtttttctagcagccttagagaaggtgccacagcgaagagagcacgagtttacgataaaacgtgcactcgcaaaaggaccgtcaatcccttatcctgaaaggagttgacggcccttagtctgcgttaaagtgtcgaataatatttttgtaaagaactcctcaaaatcaccaagccctaaatttcgctcactgcgctctcactaatcaagtgcacctcatgttcatcatgcttcaattcaggccaatattcccgattggccacgatgagatcatccaagacttccttcgccacttgggcgcttggcagagttttagataaggtcaaggcttgccacagttcttgataatcatgattgatccatgcatcgacgactaatttttcgaccatggcttggttgagaatcatcccccgttgaaacatcgggattttgccttgcgtcagcggctcggcaccgtctttgccaacgatgcacggtacttcaaccataatatcatcgtcaacatttgccaccgcaccgttattttccacgattagcaacatacgttcatgcgtgttgaaggcaatggcacaggcaagatcgacgatgaaagaggcgtggctgtcgatcgggaaggagccaacgtcactggtaccggcatcgataattttctgggcggcactgaagacgcgcttttcacggccatcttcgacttcattggcgcgcgtatagtcaggatcagagtgagccaccacataatccggatagagataatacttcaggtacgtgttcggtagataatgcggatcaaccgccaacagatcctgcgcctttttgtgagttgcttgccagctggcatccatgtgctgggtgtcgacttcgatctgggtcaagtagccatgatgagccacataatcccgaatctgcggcaggtattcattgcccgctttgtccttaacgctggtccaccagccaaaatgattcattccaaagtaacgcacttccagattttttggctgcaagccgatgatctgtgacatccgccgctgcgtaccaaccggcatgtcgcaaatattgagaatcttagcattaggccgtaatcgccgacatgcctccgcaacgatagatgctgggttggagtagttgagcatccagcagtctggcgaatacttttccataaaatcaatcagttcgataatatcgccaatactgcgcatcccgtaggcaataccgccagggccgcaagtttcttgaccgaccacgtgatgttttagtggaatcttttcatcttgctcacgcatcttatagccgccggaacgaatgtgggcaaaacagaaatcaacatcagtgaaggcggtctgcggatcagtggtccaagtgaagtcaatcgctggcgccttttcttttagctcaatagcaattgcctcagcaatcgtcgcctgtcgctcttcgtcgatatcataaagtttcaatgctcgcagtggaaaacgttccgcattttccagtagcatcatcacgatccctgctgtgtacgtactgccgccacctgcaatgacaatggaaaattgtttgttctgattcattatattgtccccctaaacgcgctcactgccacagaaacctgcgtgtaaggaccttgaccgcaatggtccaagcccggcccggccatcacggtcaaggcacttacacttcgatttctaaacgggcttgttcacgctctttctactcaacttctgccgcatcaaagcctaatgcttcatccaccgccgcgcgaactttcgtaacggcaaggccataaacaacatgcacattgttgccttttttgatgacaccactcgcgccggtttcattttttaagactgtttcgtttaccaattccggattcttcaaaacagttcttaagcgtgtgtagcagttcgtgacactttcaaaattgtcggcaccgcctagcgcctcaataatcgttgccaccggtacttccgtcgcacctttaggaacactgaccggcggagcttgtttcttttcttgatactcggctttgctgtaaagcttagtctcttctgcatcagcttcacggccaatcgttttcaaactgaacctgccgattaagaatctgaaggtgaagtaatagataaagaagaacatgatgccgacgacgatatacattggccaatgggttttaccgacccccagcggcacattgtagagcagaaaatcgaggaagccattcggaccaatcgcccgaacgttcagaaggttcaaaaccaccatgcttaacccgcttaaggctgcatgaacaacaaacagcaatggtgcgatgaacatgaaggaaaattcaatcggttccgtgacccctgctaaaaaggaggtcacaacggctggaatcaaaatggctttcactttgttcttgttttcaggttttgccatttgatacattgccaagcaagcaccgatcagaccaaacatttttgagatgcctcgcgcgtcccagataaccgaacgtgacaacagatgaatattggggttagccatttcggcgtagtagatgttccgtgcgccttcaaaaatgtgcccgccgatttcttcaaccccaccaagcgaggtatacaggaatggcgtatagataaggtgatgtaaaccagttggaatgagtaaccgctcaagcgacccatacaggaagaggccaaaattgccggtttgattaatcacgtgccccagactggaaatgcccatttgaatgaacggccagacatacgtcagcaagactgctaacatgacagtaactggaatcaaaacaatgaagacaaaccggctgccaccataaatttgaaaggcactgcgaaattcagtatccacaaatttgttatgaatgaagccaaccgttaaccctaaaataatacctaggaagacccccatatcgagaatttgaacgccaagaaccgatgcttgaccggtaccttgaagattctcggccttcgataaaatcccgcgcagttccataaacttgttcatcgcgttaatgaagaccaagaatgtcagcagcgccgtaaacccagcctctgccttcttcttcttcgctaacccaacagccaagcccacacagaaaatcaccccaaggttggttaaaattgacaccaacgatccggacaaaatcaagccgaagccttttgtcaccggattattcatgaacggcaccacttcaagcagcttctgattggtaaagatgttcccaatggcaatcagaatccccgcaatcggcaggatcagcacgggcacgaacatggccttggaaaagcgctgcagaccgtccataaccttctgtttcatctttgtcacctcttctagtaatagtaaaataatttcttgttgatctaaacataacagacaagctttatcgtgaaaaccctttcaagacaacaagaaacgtgttccgctgattcggaacacgtttcttgttgggtggttgttttggtttgtcggtagttgctagcacaaaagaggcgccactagggatggaagctattcatcttcgtttggcagttataaattttagttctaaccgcatgttgtaacccgtctgactattgcgcgcgccgtttacgccaaatcatcaagccgccaatcagcaaaaacatgcccacgcctgccaaacttagccattgaatgaccttatcgccagtttgtggcatatctgcttgcgttttctgatgccggccgtttttatcagctggtaacggcttggtcggtggggttttgctgcttggatctgtctgtgatcgtttgacgagcgctttttgtgcagtaagtacggcattcgtggcgtgatccaccataacttgggtcggctcgtcaagcgtcagaacgtcttttgcagcatcaatcgctgcttgcaagtcccgccatgaagcatcggtataagttttcgcatcaagtttcgccgcagcagtcaaagcagcctgaagtgctttcgtatcagcagtttttaccaacccatcaatggctgccaccaacgctgtattagcatcatccactgtctgctggtcagtcgctaaatcggcgatgactgcttttgcttccgtcagtgcctgcgttaaggtcgcgaaacttgctttcgtgtaatccttcgccttcaaatttcctgcagttttgatagtcgcagctaaggtagtacggtcaactggtacatcgagcttaaaggtgaccgctcgactggcgcctgccaaatcagccggattaaaggtcaaaacatggccgttcgttgaaaagagcgcctccgtctttccttgaagatgaactgggtagttaaagctgaagttgattaggttaccggtttgacttggttcggcagccgtcagctgataaacattgtcgccaagtgctttgatgatgaccgcggccggctgatcaattgaaacaaggccatccagttgatcggccttggtccaaacattggccatcacctgatcttttgtcttgattgcttgcaactcgccagtatttgcgagaaccgtatagtctggtgacttcgctagttgggcgacttttgtatccgtcgcattcggcacagtgacatattcatacgatccgtttttaacggttgcgccatgcatggctgccaatgttgcataagtatgcttataaaccgtatcggatgggaagtacccattaatatctttgtaggtgcctgtccgcgtcgcctgattgatcgtaacgggcgcattgccttttgcgataatatagccaacattattttcgggatcggcggtgttaatatttgcccaccggctgactgtcttttcgttcgtatatacctgaccatccaccgtcatctgggtcgttgccggattgatttgtcgctggtcaataatggtttcgatatcggcggcagttgtgccattaatattggcaccgagattaatgatttggtcatcaagtaaaaaccaggatttcatcgcctgcaggttctgcccttcattgactttattcaatgccatgccaacgctggcggtggtcccatcagtcgcgccaccaacccaagcttgcggactttttgaagacgacttcgcaccatccggaagtgacaccgtgtcaaccgtcgttccgggaaggcggtacggatcaaccgttgcccagtagccttcaccgaattgattcaaatcattgttatacagataaaccatcccgtcagccgtatgccaagcatggctattttcggtattgccgtattcaaaattggcaattcgattggagtacattgcgatgccaaccgcgtgcgtcggtgttttttgcatgactcgatccatcgccccataaatattgagcgaactgacgtcatctttctgagctgttgcctgatgcaaagccgttttgagaccatttaatgtcgcgtaatctcgtggcttgtcataaaaattgtagcgctcacccacctgtgcaacccaagtggcaacggcctgataaattttctgcttcaatgttgctggcgttgcctcggcaattaaggtcagattggctaacgtctctttgccagtctccaactccgtggtttccgcattcgtccctggtgcgcgcgaaatactacgacccgaaaccatcgacggcatgcgtccattcaccatcaattgcaaaaagcctttgtcaattaagttaaaaacgttcgcgaactgaacttcactaatagcccaaggcgtaccaacgagggtcgatgaaacgcgcgcgatgcctttaatcatttcgttgccataactgccattgtatggaaaaaaggtgtgttgaacgaaggagccatccgcatagataccatccttggcggtcacaagccccatcgctttaggtaaattctgttgaacaagggcaacccgcttgtcatcttctaacaacaacccgctagccaaaaccgaaatcgaaatgtccgtcaagttagcccctgttgctgtgtaagctggccattgaatattaggatccttggcataacccaacaatggttgaacaaacttgaccaacttttctggatcctgtcggtgcaagtcattgtataacaggatcaaagtatcatcgagctgttgtgccgaaccgatttgccaatcccaccaattgccggtggaatagctcccgttatattttttggccgtctccataaaatcaatcgcatcaatgattgcctgatacacctcaggattttggtgctgttggcttacaggattatagtagcccaatgttaacattttaatattggtaaacatcgaggtataatccgccgaggtcgtgtccgaacttttcttcggccaaagccgactacgattagcacttcgatccatcgtcgcccatagcgtttgactctgcgctgccaagtccgtcaagtaagctttaacattgggatcactcatatccggtttggtcgcaatcaggcgatcacgccatcttgcgcgcatcgtcacatactcagcacggcttgttgctgttgctgccttctcgacaggcttagccccttgcgcaggaacttccgtggcaactggttcgtcattaacagccttcagtatttctgaactcgaagtggccgacgatggtgttgcgaccgcgctggcactatcatcagccgcgtacccagtaaccgccccagtcgaaagcgccatcattccaaataggcctacacttaccaaaaactttttcatgctcttccccctgttaaaatgattttcgatgataggtgatcatcaatcaagacgttgctccgttcagctacagccgctaaatcgttcaactgcctaaaatagccaacatctaatctcagagagcttatcatcgcataattggaagcgcaatcatcgtgaacttttggtatacaccagcaatcgttttaatattgacgcggtgcttgtaaaaataaaataaattattttcccgacagaatttattaatctactttttgaatttcaccaaacgaatcaaaaaagctgcacgaaaatcttcatgcagccagcctgccacgtaaaagtaggcagtatatttaacgatcaggatgcaaatccttgaaaaggtcggctaaattggcaaagtcttcatagcgttcattctttaaatcctagagtgaatgatttcgttccgcctcgctgattaatgtaatacctcaaacttaaagattaaatccatggccagattttgccgactcgaataatcaccgaaatattggcccgacaacgacacactggtcttagcctgatcatctaacgttcctagctcttgattcgctgttgagtcatcaagcgggattttatttgcggcaaatttttcgttgcctttcaaaaataatctggcactttctgaggcgtttactggatcaggatcattaacatgcactaacttaatcgatgatttggttgtggtcttaacttgttgcaaaaccactttgacttttgtctttgaacgattcttgatctcatagttgggtgagacaatctggcctggatcaacatcagtcgaaccaaaggcgatacttttcggaatcgtcaaatcgatcatattgtttgatgctaagacattgattgaaatctcttttagaagcttaccaatcgctaatgttgcctgataagtaccaaattcaggctttaggtccgttgtgatcaccttgattttctcggagggggtctgcttattcttttcccaagcctgagcttgactttgcttcaaaataaacgccgccaactgatcggacgttttattagctagttgattagaataagcggttatgttttttgccgtgagaataaattgatcatccgattgatcgtctgtatctttgacgacaactggaattgtgtatgtgaagaacaccttattccctgaagtaagcttttcagaaacttgcacctttatatcttgaaacccatcgtgagtagtgtccggatagtcagttatcttttcgaatgtcaccgttgcttgcttgtttttatcaatagcagttttaacttccttttcaatcgcttcttttttaacagctggtgggacgaccaaccctttaaaagtcagttggttaattttcaaaggtcgatagccattttttgtaacttcgaaaaagatttctttcggttgctgatagcggtttaaggaagtatacgtagaatcttgcgtatagccaattttcccttctgcttctttggctttaaaaacatcgccgtaattaacggacagcgtacgagaagcgccccaacgattcaaaaagtcttgcttcttatcatcgccgttcgctttaatgaccatcgttggcgtacttttatcaagtgctaactcggtatgctgattcatgctatacaaagcagtctcaacataaaactttccaggaaacgaggaatgaatagcttcgttatcggttgacttccccgaagtcgcgatgattttcgggttaccattttcctcaatcaaagcgaacacaccagctgaatcacgagggccatattcatatcctcgtaagacaatggcattcccatactttgcttcaactggactgacagaagtgactgttccgcccatggacgcaaagacgagttcaacggatgctttaaagagcttatctattcggtcatctttgagtgcttttttaacttcatcagggttactcgacccgactctgccgtcactgtatggcacatcactgccatcagtgtctgtcgctgacaccatcatccttgaacgattttctgtgttccacttttcaccaagtttataaaaagcctcctgtgttttaaattttcccggcttggcgaccacggttactggcacttcataaggataactgacttttttgccactcgataaggtttgtgacacaagcactttagccgtcttttcacctgcagtatccacatcaggatactccgaaaatttttcaatggtgatgtttgaattacccttagtgtcaatagtatttttcagttgttgcgcaattgtactttgcgaatctttttgagtgactgagatttttttagaacttaattgattgatggctaatggcttgtacccattttttgtcacctcaaaaaagatttctttaggctgttgataggtgtctaaagaagtgtagtttgaagcttgcgtatagccaatttttccttccgcttcttttgccttgaaaacatccccataattgaccgacatcgcacgggcactcccccaccgatccaaaaaatcctgtttcttttcatcgccgttggcagtgatcacctttgtcgggttttgatccgcaagggataagttggatgtaagctgattcctgagacaacttttaagagagggtataatgaataaatcgtctctcaaaaggaaggaatttttacatgccaactcgttacgacaaagaattcaaacaaaacattatcaacctatataagcaaggcgaatcagctgcccaactggccagagaatatggcattggctattcaacagttcataagtggatccagggccaggccaaaactcaatccggtaaatcgccagacgaaatcaaagcgatggaaaagcgactggcttcgctgtctgaggagaacgaaatcctaaaaaaagccctgggcttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgtggacttgaaacaacggattctgcggatctttgcggaatttaagcagcgatacggtgttatgaagatccaccatgaattgaatctggaacttcaaccactgcagcttcggtgcagtccacgacggatttcccggctcatgaaggaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtcatggctggtgttacttatcaaccatcatggacctgcactcacgacggattatcggctattcgttctcaaaaaagatggatactgatttagtcttaaagacccttgaaagcgcggttaaaaatcgaaccattactggggacctgattatccatacggatttaggatcacagtataccagcgatgattacaatcaacgtttaactgaactacatatccgccactcatacagccgtaagggttgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgacttaatgctttccagggttcaaataagttattaatcgcaattgatgatttatttgagctgtggaaggtaaacgcggttctgaatgtctcttaaaatctgtctcaaatattgacttcaatccaagtcgttaacattattcatgctaaacaaagcagtttcaacataaaactttccaggaaattcttgatgaattttgtcattgtcgttaactgcaccggaagtggcaatgattttaggactgccatcctcttcaattagggcaaacgctcctgcggcatctcttattgactcaaccccattttgagcttcaaacccccgtagaacaacggcattcccatagcttgaggtggctttaccaggcgaatctatgcgcccgcccgatgacttaaaaaacaggccaactggcgaatcaatattggcatctattctgccatttttaattctctttgaaagctcgtctgggatggtcgccccaatcctgctgtcactgtaattaacagggctaccatcggcatctgtcgccgacaccatcattcttgaacgacttgctgtattccacttttcacctaaaacatatttagcgttgcgcgctagaagaaagccaagtggtattttcatttccatagattcgctgaattcagtttcaattgccggatatccatttgaattctcagtataatattgaaaactggatatgcttcccattctcaaatcaaatttccaagctaatttatatttaacggaaatactaactttagaattagtgccgaagcctcttttgagtcgtacagtcgatttattcactaccttagctgataatgtctccggatcactagattttacttcgacaatctctctcgcaacctggccgacttcaataacaagattgccgcttactctctcttctttaaaagttggcgatggttttaatgacacttctacttcttcccccgctttactcccaacctttgtcgctttaagtcgctggataaaatctttccactgcgcctcagttttacttctcacgagatttggataagatcgggccgcctctactggacgcgggaatgccacagaagttataacaagggcaatgactagcaatagattcaaaattttcttcatttgctttactccttaaaaaatcagcgttataccaaattttttcgatgactggtatgacgctgattctcatattgctaaggttcgacttttttggtggcattgctggcagttccctgattgccatcttctccttgatatttccttgtccagtacacgaaaattgcaccggaaaggcacagtaaccccaacatcaagaatacctgcgcttgcgcggcatctgcccccagttcgggcatctcctgccttattttgtcattaggttccttgcgctgaacaatcggacttttgccggcatcgcttttgtcagtcacatcaactggctggttgccaatgatgccctccacctcaatacttgcattggtttccgcaaggcctatatgcggtggcatatttataaagaaaaacaaggccatcaagaagaaactaagctgtcctttcttcatcatgatctttactgtacttcgaatttaaggactaatttataatttgccttaactgtctctttggtgaagtcaaaaccttttttgacacttccagccaaagtaaactggattttcccgttttggcttgtgatcgtaccaatctcagtaggaaaagaaggtactttttgtttgtcagttgaacgcaaagcaatctttttgccgtctgagtttaaatttagatccaagcgaccctctaatttattagcattatcgccatcagtaaaatcattaatggcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcgattgaaccgttcatttgtgccccgttcattcgggtgataggcatggcaaaagtaaaccggtatccgatagcgctttgtaagcgcctgatcgcaggaaaactctttaccgtgatcaaccgtcactgatcgaaccggacccggaaagtccaccatcagtcttgcaaatcccttgagaacagcattttgtgataagttttcaagcttagttgtcgccattaaacgtgtcacccgatcgacaatggtcaaaacagcagcctttgacccgcgaccaccgcgaactgtatccatctctaaatgtcctttttcggttcgccgattagctgactcactgcgaatctcaattgaggtgcctactgcttggttatagcgcgaccgaaggtcttgtcttcttttatgacgtttaccgtgatcaaagagttggcttggctgaaaatcgacttgtctttgataaatccagtggtaaatcgtgtgtggcgcacagtgaacggcataaccgaccatttcaggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggatggaaactttgacgcctttggctgatagattctggatttcataattcggtgaaataataccttcactgacgtcggtttgactaaacaaaacttttgagggaattttgacatcgacccatgctttatgatcttttttaggcgttggtttagccggatcaggtagtttggtaggatcaaatggttcaaacgttccttcagccgaaatcgttgcactatctgttttcttcacttctagcgtgttagtagcagcatgaggatcattttggccattttcgtaagcgtacacttgggttgatccaagcagtgatgcccctatagctaatacaccgcatagtgtcagaagttttgtctttttcatttttgttcctccattagtttgcttttattgataactagcagactagttattcactgataattgaccgacaactgcggtttcaccgatttttgttgaagaatcggcaagttcataataggtaacggtgctttgtgtcttataaacgcctcttttaaggttggctttcaattcaccagcctcaacatattgtttgggcttaattaaaccggaatcgtaaatgactttgttctgtccttctaatcgtgtttgcacccgaatgccatactggttgctcgcaggattcaggatattgactgttccgacttcatttgcggcattgaaaaccatagtcgtatcaagcttcaaatgaaatttgcttttgtcggctttttcttgcagatattctttgagttcttcatccgtcatattcttcacgaaggaagtgtcttcagcaccacctccatttgcaacaacattgggaacgcttctgtgcaagtacatgtagcttccaatgctgacaatcccaactaataaaagcagtaagactaccagtttcaattttttgtttttttgcatgcaatttttcaaccttcccaattgaattccaaatcgaaacggtgttataatgcacctgatattagcaatttctaacaatgaaagttagtataatctaatttccagcctagttgaagttcattttttgcctaacgttaggcaaagaaggagagtttatggaagaacttttagaaagcaatttgcttagacactttcggattgttcgctttttacttggccgagaatgggtgacaattggcgaactcgctcatacattgcgtattccatccagaacgattcgccaaagcatcggggaaattaatcaatacattaatcccgctaaaattgaaagtagtcagaaatttggtatccgattgacctatgacgctcaactcaattctttttatatctatgcttcaatttataaacaatcggcgcactttttaatcatcgaaaatatttgtatccatcaatatgcaacgctggctgttttagccgaaaaacttttcattagtcagtcaaccttaaaaagaaagatagcggtcatcaatcaaactttggaaaaatacggcttttggattgataccaagtcagtggacatggtcggcgatgagagaaagattcgcttttttattattgctatttgcttgaaaaatatgatgtccttgatcttgtcgcgcctgagcaggaacttcgggtcatagatgagcttatttcggagtttttcgcccaatttccgtctttacagggccccgaacggcaggtcttttcctatttgaataaacttaggacgatgctgttcatcagttttaaaaggcttaaaaaaggacgccgcttagctagccacgatcaaatcaacgaacagtattcccttttactttcagaaaagttaagtaaaaaaatagcgatctgctatcacattgactgcaccaaagacgttcttcatcagttgttctttttattcttcaaccgaagatatgcttggtccgctaatgatcttcaaaaaaagctgaacacgatgaagccatcgcaaaagtccgtcgtactttgctggcgtttttcgcgaagatcgaaaaaagtgaacaactggttctaattaacaaagatgagcttttgttgctgctttacaacgcaacgagctacacctggacttcagctaaaatcttgcataaccctagcgaagacttctttgtcaatctaaatcattaccatgaaggatttgcccgccgcatcaaaaaagaattggtcgcttgtttaaacagagaacagctcgacatctacctggatgattcggtgatcaatcaattactgtttatgctcgttaccgcttggaaaggcttgatggatcagctagaagcgagcgccccacgagtaaaggcggggattttctttaatactagttttgaacacagtcagtttttgctgaacgacatttcatatcatctaaaatctcggcttgatatgacactgatcactgccaaaacgatcaccgagttgcgccaacaatgtcaacatgttgatatgctgattactaatctatctatgctgccatcacctgactgccatattgtttcgatccaagcaaacctcacgccaaaagatttcgaaaacattctctccgtctatagcgagattgtgaacgccaacgtcacagcttcttgacacagtaaggaaagtgaacacgatttatcaacgtaaaaaagtcagagcacggtccggatttcggagcgcgctctggcttttaacatgtcttaacctttctcgtcattatatctgctaataaaaccatacatcaacaacgcctagctcaatccagcttctcaacttctccaatcaccaattcaaacgccgccaacatccgtggataaaacagcgaagcacgttggttgagatcgtctaagggaaactcatccgggacggtcagcgtccagtcggctattttagccaatgtgctttctgggttgccagtaaacgctacaattggaatcggcaaactgctgaccaatctcgccttatccaagacactctgcgtttcgccagacttagaaacgactaggaacaagccgagatcttccaaatagttttccaaaagcgctgccgagtcccctggcgtcgagaaaaagcaacgcttgccaagaatttgaaactttttaaacatataattcccaatcacaccggaaaaccctgccgcataaacatacaggtaacgattttcaacagcggcgatacgctgggcaacggtcttgatggtgcttagatcgttgtgactggtcatcgccgtcagcaactgatcctgctggtcgctcgccgctgttcccatgctatcgtgccgcaacatcgtcataagcttatattgtaactcgacaaagccgcgataccccattttatgcgccaaccgcatgactgttgtcgccgatgtatagtttgctttcgccacaccgcgaacgcccatgtccaatacacgatcaatattggccaccatgtagtgcaacacttcctgctcggtctcagaaaggtttttccctgaaactaacttatcgaatttcattacactcaaaaatcccttctgaaaacgacacagccgcttataaaaaagccgccaccttgataaccagtggtcgaccttctacgttagccagcataggttaatgtcgtcacggcatcgccatgcgtcaccggccctgctttgatgggtgaaaagtccttcaccttgtccatgttggtaaaaatcaccacaatcgcagcatcgcgatccgaggcctgaatagcagcaacatcaaccgtcgacagcaaatcccccgcctttacctgatctccggcggcaaccttggtctcaaacggcgtcccattcatctctaccgtatcaagtcccatgtgaactaacacttcaagtcccgcgtcggatgtaatcccaatcgcatgttttgtcgggaaaaccgaactgatcgtccccgcaatcggagcataaactgcttgttcttctggcgcaatcgcgtaaccctcgcccatcatcttctctgaaaagacgccatcgttaagcgtatcaagcggcattaattggcctgtcactggagctgtaaaaacatcacttttttcttttttaaatagcccgaacattcattgccatccccttctggttaccagtcaccatgatcaatttttacagataaccgcggtttttgcaaacgtttacttttaattgagaggcaattgcttattttggcagcttggcacgattttctagtgacaactatagttaacttggcacacactttagaatcaacgttattgcgatgcttagattcagcatgctatattagaaacacggaagggagctccggcctgtaacggtacccctgacaaaaccgttgaagacggtcgacattcagttgaacaatcgattaagaccgttaaactctgtcaaaagttttagtgacggtctttttgctgcctcagatttaaaatcgatatcattgcgacgccttgatcctgcatgctataatgaagacacaaaagggagcaccggccataaccagtactcccttgacaaggccgcttaagacggctggcattcatttacagccaaaaagaccgttagacttcagccagaaatctagagacggtcttttttgctgtctaggattgctaccacaatcgtgacgatgagcgcaatcaatgatagtataaaaccaccaaagaccagcatcagcatcaaggcgtcagcaacggacaactaggcacctcccttcgtatagattttgatcatcgcgcataggcgatcacctcacaatacgttggatttgccaaccgtcattcactttcttgtctcatccattatgccataccaaatagcaaaacgcctagagtcgcaaagattctaggcgttttttaattcgttaaaatggtgtttatctaaaactacctgccatcaagcttcaccctgtaccagcacattgcaatgtcttgtgcggacacgattttgatcccagtcaacaaagtaaatagacccaactgatccggtttgaatctcaccattacgaatcacaaaagtttcgcttgcgccgaacattgaagctcgaatgtgggcatccccattcaaaacagtgccatcgtcacctttataggccgggttgtcctgaatgctatgcaggaaatcaatatgcttaggaccaggatacttataattcgtattttcagtgagttctcgtggtaccaacttatctagctggcggctcatgtcgactaatagatactcgtcgccattaaagtcccgatcatgcgtaaactcttcaaagatcaccgaacaagttgtatgtggcgattgaacgacacaaatgccattttgaacaccactggccttcacaaattgtttcacttgatcagtcacattatgaaatgtcacccgatggccatttgaagttagatccaacacttcacttttaactgtcatgctaactgtgcctccttgtatgctgccattgcacccatcatttccatcaattttgcccgccaatcaggggcattaataataccgcttgtgccgccagttccatcagcgcccaatgccaataccttcttgacatctgcgccagtgctgacaccagctgcttgcatgatcaaaatatcaggatcgacactgcgaacggcatcattggtcgctttaatatagtcatcattgctgatacttccggtcccaattaaactggttggttcgcaaatcatcatggttgggtgcagactcgcaatcgcgcgactttcagaaggcgtatcggaacagacaactgtcattaagccgaccgctttagcacgggtaatcgtcttatccaaaacaccgatttccagcggattttcagcatgattcagcacaaccgcttcaacatccgcagctttcagggcttcaggtaaaacatggcccatgccacggccgggaagcagcggatccatgtgctgtgccgtgatgatcaagtggctcgttgccgccttgatccgtggcagatcaatcagttgccccgtaaataaacagtcaagatgcttttcggcagcaatctcatccgcaatttttgccagcttcacggcatcatcaccataaagatacgacttaggattcacaatgaaaaaaggtttcttaacacttgccattccaacatcaccctttcttgaaaagattgaaactcacagcgcaccgagtaccgttttctcttcaatttgatgcaacttggccgtattgaaaacatcaacatagtgctcatccaatgcttcaactgctttctgctcggcttcgatcatcttgagaacactttcataatgttctgcttgggctgcatgcaaagcagtattagccaagtcagtgtagatattgaccttagtgatacccaatgccgcggccttgcttaaattctcatcaccagatgacgacccaccgtggagaaccaatggcaccgcaactgcttgtcgcaattcactgagccgctcaaaattcagatgtggtgttttggcacttttatataccccgtgggaggtgccgattgatacggctaaagaatcaacattggtacgcttaacaaactcgactgccgcctcaacctcggtatactgattggcgtcatccgcactcaaaccagtgccgacatggccgatttctgcttcaacaacgaccccacgttgatgtgcataatcaacgacatccttcgtcaccgcaacgttcttatcgaatttttcagccgaagcgtcaatcatgaccgaagtaaagccatgatcaatgccatacttaaccaagtctggtgagaacccatgatctagatgcaggacaatcggaactttggcatgagcgccatagaattttcctaggatcaaagcttcatcaatatcaatatcagcttcatgcttctgtgcccatgccaacaatatcggcacatttttcttctcagcagctgctacatgggcgcgggctgacatttcatcccaaaagttgaagtgtggaatcgcaaaaccaccttcgcgcgccgttaacaacaagttttttgaagaaatgagcattattttttctcctttcctgtttcgatatcctgcttgatcttgtcgtaaactttgtcggcaccaatgccggtcagcaacggcacaccatcaatgactttctctttaatcgaatctggtaccaatgttgtggaaacaacgatgtcataatcatcaatatgattgacttcctcagccactttgctttggtacaacgtcacgtcttttgtaagtccttgattgtccaaccaagtcttaagcttgcccatgacgacggttgacgttgcaacaccggtaccgcaaataactaataacttttgtgtcatgatttttctccttttttgtaagcacgagccggcctagcaatcaggctgcatctcacgttttctagctacaatgaacttaggctgcaactttttcttgcttgtcccggactttgttaagccagaatagtagacccaaagcaacgatgaacaacacgccgacgccgagccactggaacttttcacccatcatgagatagataaagttggtccacaatccgccatcactcaaggctgagatagagttgttgccacccatattgaaactggcagccttggctagtttggtgatcaacggcgccgcccaactcgcaacatagaggctaatcgcaatatcaacggtccccgcaaccacggttctgaaaatatcgcctttaaaaacggcggcaaacaatgcgatgaagaatggaatcgttgctaaatcaccaaacggtaagaccttgtttcctggcaaaacaatggccagtagtaacgtgatcggcactaacagcagtgctgatgacaaaacggaaccttgcccaatggccaaagcactatccatcccaatgtataacttgcgacctgggaaatgctttttgatcatgtcattggcgccttcagagatgggcgttaagccttccatcagcagtgaaaccatgcgcggcatcaacatcatgaccgccgccatgctgacagccagattcagaaccttattcagtggttgttgggcaagaaagccgatgattaaaccgataatggcgccgatgactgtcgtatcaccaaacacacctaagcgtttttgaattgtttcagcgtccagatggatcttattgatgccaggaatccgatcaaacaaccagttgaatggcaacgcgaagacgtaacccggggctgacaaaccatgagggaaggaaatgccttccaagccgtaatacttaccgacagttggcgcactcagatcagcgaagaagtaagtgaacattgtcaccacaaccatcgtggcaagccccagccacatgttgcctgtcagtgtgtacaaaatggaaccggcaaacgcgacgtgccaataattccaaatatcgacatccagcgttttggttaggccaagaatcaacaaaataatattcgtaccaacgccaacaggaatggccatcgcgcctaatgctgtgccatatgcgatcgctgaagctgctggccacccaacatcaatgctgctgagatgcaaaccataattactgatcattgactttgttgctggtcctaaactggttgtcagtaaattaatcaccaagttcagaccaataaacccaatcccaattgtcagtgcggatttaaacgctttgcctggtttgattcgcaatgcgagtccaaaaagaaacaatagtattggcaagaagacactcgcccctaaattgacgatccattgaagtacttgcattgaagttctcctcctttaaacgcgtttacagtcgcagaaatttccagataagcgcgcttgttcacgctctctttaaacaactgccttgctgcaaaatttcccacacgtgccgttacaaaacaccctgttccgtcatgaaatgaatgaagtcatctgctgtcttaattttcctaaaagctgtcatttctgcatcatcagcaaacaatcccattaatttctgcaacatatccaactgttgatgcgccgttttgagcgccagaacaaataaataattaacaggcacaacgtctgtggcactcgccatttgccgaaattcaactggggtttttaaagaaacaaaaccaatctgatcatggataacctgatcggcatccgtatgcggaatcgccacgccaataccatcatttaattgcaagccagtgggataggtttgttcccgcgcaataatggccttttcaaaagtcggcgcgacagctcccgcctttaataattgatctgcaaccgatttcaatgctgtgttgcgatcagaaaacgtttgatcaaaagtaatcacgcgatccgagaagaaatgattcacgcttgtcttctccataacattcactccatttcgaacaattgattagttgatgcttcgtccgccaactgttgcatgatcggccgaagcttagcgccatcgtcgccgtgagcagcaatggctagtaccacgaatttatcgacaagatgatcctcacctgagtaagcagatcgccaacgcatgggtgtcgcggatttgatcagcagcacccctgcctccgagaccgcatcagagatcaggtgcaataagacaacaccatagccgatatacgtttctccttcgtactcccgttccatgatgcgttggcgaacctctgctgccgtcaactcagggacatctcgctgaatgttggtcacgatgacttgaaaaagatgcgtctgatcaaatggcgcggtcattttgatcaactgcacattactcgattgctttaatggcatggcgaatcttctccttatctaaatttgacaacacagcgctaactaatacctttgggattgctagtttgtcatactgcgaaccttttagatcaatagttgagacgatcaaatccgtatttttaagtgagttcagatcaatatcggtgaataaccctgtcgcagtttggtcaatctttaattctctaaatgttttttctagtttgactcggagcagttccgatgtgccaataccactggcgcaaatgaccaacgtttgaatcttatgatcctgctgttccaaaaaccgggcaaaatacatgacgataaaaccaacctcgttttcagaaatttcaggtaaggcaaattttttagtcgcttgctgtgtaccctcagctaaaacctcgaacaaactggcatattcacgtttaatatcagttaacaacccatttgtgacggcaatattgttttccaatcgattaatgagaggtgccacatgaccggctaactcccgccaagtcgtttgttgaatatgcgcagttggtaagtgcttattgacatagttaatgagaaaagccgaaacctcatgaactttgggactgtatgaaagcattttgacgttaggcgtttcattgtcaattcttgaagaaattaaatattgaaagagataatctgtttcttctggtggcaactgtttagccaagtaatcttcagtgttgccaataataatttcagccaatcgataaagatgcatattctgcagcatcaacttgcgaacttccacgctattcacaatcttgagccgctcaacttttccttgacgacgaacgcgttgaattaagatgtacaagtgcgacaaaatattcacattatacggataagccagtttgccgccggtcgcttgttcaatcacttgcacctgtcttgtaatgaattgctggtcataatctgtaatgccttcaatcgtgccgccagtggtaatcgtggacatgttttgcaaaaccgcactgagttgttcacgaattcgtgtttcttcgccttcgatatgaacggtattactggtccgtataagcaccaactttttcttggccaatcgtcgcttgagatacagcaaatcattatcaatcgtcgcatcactcacatattgttccgtatacaaatcatccaatgacatttttactggtgctcgaaatagcagctgttccaacacctgatttcttcgttcaagactactttgactagcactgtccatctgctcattggaggaactaagatcaggcaatgcactcggcaacagcctcgcaccttttccacgaatcgtttgaatcacaggttcatccgattgctcattaatttgatcaatgtggcgataaatcgtttttgttgacgtgcctagtgctgccgcaacctctgctgcattgacaaaaccggcacttcgagacaaatagtccaacaaggctcgatcgagatccccaacatgattcactattgcaacacctcctcacacgtgcaaccgcttacaaatatagtatagtgaagcccattgccaatcgacataatctggtgtccataggttcggacattgggtttgtggacatctacctgaaactcgcgtcaaaaagattcggtagcctccgaagcactacaagtattaacttctatagataaaaagggtatcgtttcgccttacgttattaggttaacctctgacattcaaataatgtgaatgccacgcaaaaataggggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaataccagaccataatatcaaagttgcttttgttcgtcatgaatatcgcggcaacggggtacgtcgccgccagtatcatgtgattgatgccgagctgacttaccggttaacccggtgcccactgtgtggctttgaggccttgcaccctaacgggttttatacggcccacgtgcgcgtcctcaatggggttgaaatgccgacagtcattgacttgcacaagcaacgatggcgctgttataactgttaccacacagtcagtgccaagacgccactcgtgcaacccaaccacacgatcgccactcacatgacagagcgaatcatgaagttagcgcatgaacggttgccagtcaaaaccatcgcccgtattatcggaatctcagcttcctcggttcaacggatcattgaccaaaatctcaaactccgaccggctcgccggctgcccacgcgactctgctttgatgagttccgttctactcatggcatgatgtcgtttatctgtcttgatgccgattcacatcatctgatagccttgcttggtgatcgattcaaccgcacgattaaaaacttcttcatcgctcattattcactcgctgaacgcactcgggtccagacggtcaccatggacatgaatgcagcttatcagacgattattcatgaggttttccccaaggcccaagtcgtcattgatcggttccatatcattcaacttgcggctcgtgcccttgatcaggtacgcgtccaagcgctcaaacagcttgatgacaaacacagccgtccttataagatcatgaagacaaactggcggctttttcatcaaactgcgcctgacgctaaacacaaacagttcctgtttggtttgaatgaatacgtcacgcaacaggaggccatcgatatcgcacttgatactgagcccaagctcaagcaaacctacgagacctacttagcgcttcatgatgccttgatggtgaagaaacatcccacggaactggcaaacctgttagctacttacgagccaaacggtacggcaatggacatgacgatcgcgacgcttaagcgacacaaagtcgctgttctcgccgctgtcaccagcccttattccaacggtccgatcgaaggggttaaccgcctcatcaagtcactcaaacgatcctgttttggcttcaagaatcagctgaacttctttaaacgaatctaccaaatcacggcataacatgacaaagacggctccccaaatggagaaccgcctcaaatgataaatttattcttcaacaccagttgacgtagagccaaaaatagccgtcccattaattgaagaacgactatatcaatttgatgctatttggatcttcttttcaaaaacgatgcttcaccattcagttcaattaccgctgcaatcctggcaactgccaaacgccattaagtcgtaacacatcgtccgtaacggcatttttctctggcgtaccatagttattaaggatctttttatcgtccacgtacgcaacctgtgtgagaacaggtgccttatcgttcttagatgtattgcttgcaagaacaatgtcccccgccattcgatacagtaaaaatgctcggcgcatgtgggtggcactcgtaatgagtgtcgcacttgttgcccctctatcgactagttcgcgcactgaaaacagggcattttcaacggtattcgttgacaaatcctctaattcgactcgctttttggcgatgccatgcgcgaccagccatttctgcataaccgttgcttcagtcaacttattctccggaacgccgccagcaactaaaatctttgacttgggatacttcttagctgctttcaaagcaatttcaaggcgctttttcatcgttggttgcatcttaccatttggacttaaagcataaccgagaacaacaaagtagtgatggctatctttaggcaagtcatttggtatcttggtctgaatgtccaacttgccaatctcatcaatttggctaaacgccttcgtaaaagtcgcggtcttctctgcgttctgtgcctgaagtttggcaatgttatcgtcatatgtagctgtgtcacctgtaacgctactaaaagcagcaagtttaagccgtgcgtcaaagttcgtatggtccttcttcaaaacgttctgccacatctttgccgcagccgcattattattttgcatccgataagtagaggctagatccatttgtaaattcagattctgcggatcaattttgattgcttctttgaacaactgctcaatgacatcgaaattactcttgatagtgacgcccttaaaaaccttcttctcgttcttcttgagttggccaccattccaatagtaataaatagccgcatcttccaaatcactaacacgttgttccgttggcatcgtcttttgaacagtttcagtaacctcttgagcttgctttttagtcatcgtaattgcttgactattgacaggcttcaccaacgccaccgacagtaatattgaaactacacctatccaaatttttctcactctaagtcccccttgtatgatatggatccgtttaaaattgtaaccgattacacagattttgagaaacccgttaactattattaattctaaaataaaatattctattaacgatatcaactgaatagatacttctgtacataatagttttttacaaaaaagcgcctgcccgaaagcaagcgcaccttaaaattcaactgattttaacaactcgaatacgctcataaacgagtaactatcaagaaatctctttccaaacatcaacacggtacaactattaattacgcattgtgaccaaactttatcgcaagcgcaattgaagctaacatcgacgattcattagcaatgccctttccagcaatatcaaaagccgtcccatgatcaactgatgttcgaatgattggcagtccgagcgtaacattgacaccttcatcaaaagccaatagtttcattggaatgtgtccttgatcatgatacattgcaacaacaatatcaaacttgccctgtgaagccttcaagaaaacggtatctggcggcagagcgccctgtacgtcaatcccttgtgactgcttctcctttacggcaggattgatttccttaatttcctcatcgccgaataagccatcttcaccagcatgcggatttaaacctgcaacagcaattctaggcttgcttataccaagacgctttatcgcactgttagctaaatcaatacattcttcaactcgagcctttgtcacaaggtcacacgccttacgcagcggcacatgtgtcgaaacgtgtacaaccgcgagttttttgctccatagcatcatcgtgtattttttagtgccagtgaactcagcaaagatttcagtatgaccatcaaaattatgcccgcctttgtgaagcgcatctttatttaatggcgctgtcacaacaggaccaattttcttcttcattgctaaatcaattgccacttttaagaactgaaatgctgcgtcgcctgaaatagggcttacttcgccaattggaatcttatctaacggaatatccatgacattatagatattaatttttccggcttcaaactgatcgacatctttgatgaaattcaaaggcgtcttaatctttaagagatcggcatagtacgtcatgatttgcttagatccaaaaataatactttcattcaaatattgctcgtttttcattaaggccttgagtgaaatctccggtccaattccagacgggtctccaattgtaatcccaataaaatgtgtcatttttatccttcctcgttaagtattttcaggctttggaaaagtgtgtcctcgctgccaaatgcacctgctttagtcacgattcttagaccgcttgcaaccccgccgactaatttacttaacacaacgcctggcattatctctgattgaatttcagagccgctcgcattcaatgatcgaatcatttcgatcgctgtatcaccacctgttaagaatagcccgctaatactttcgttcttgacgattccagaagcaattgcggcaagattctctcggacaatccgactaatttctgatctatcaactgtgcccatttttttaaaagcgtcaattgttttttgatagtcttcttttcgtcgagttacagtaagaacagtatttttgccttctttcagttttgatcgaaccatcgcttggtattttgtaattagtgctttcctatcaggtttcaacatatcgtttatctgaaccgttatgattgctgtaccagcatctacagcatatgccatctgttttaaactggtttcgctaatagatccaacgactgctaaactcggttttgcaatcctacttttttggaatagtgcaccagctaacccagctgagcccacatacaatatgcgcttcttcaaagattgcgcaaattttgcaatcactgttaaatcttcatcagtaatagcatcaaaaaccagaacctttgacgaccttggcgataaatcgttagtatcggtttttgcaagggcaacctctgatccaaattcctttttcagcatcttaacaatatcgtcagtccataaggggtttaacggatcgttcgcaatgtccgtctgcattaacggctttccattcaacatctgaacaccattaacagtcgtcctacccgccgtcggtaatgctggggcaacaacgatcaaatccggctgatacttatccgctacagcatggatttcctctgcaatattgcctcgaattgtggagtcaactttcttatagactagatcaaactgattttgttccatgattttgcttgttagtgtcgcaaccttttcaaatgctgctgttgccggaatagtgcgcgactctgtatccagaacaatggcatgatcgatggtatcaccagtgggaaatagcatcacttcagtctggaaaccatttttcttaagttgtacgccagtgtcgttagcaccggtaaaatcatcggcgataataagatgcttacccttgttcattttcgatcacctccatttccttttctgcaactgactcgctatgcctttctggatggattttcttctcatgccgatccagcaagctcacaagcaaaggacatagaagcgcggtgacaataattgctgctgcaacttgggctgtcgcctgagcagcgacttgtctaaatgcgggatcaattgcagcaacagctgcaggtgtcccaatcgcgttaccagcagtggctcccacggccgctccaacttgaggaaatttcattttcagcaatttataaacataataccctgctaatccagtaacaactgtacagaagattcctaaaataataccactaatgccagcgtcaacaagttggctaaggttcaaagcagcacctaacggaaatgcaaagaatggtatgagtaaggttgtcccaggtgccaagaacttacgaatttcggagtcggcattaccaagaataaacccaattaggattggcatgatagctgcaattaatgccgttatcggaatctttgccaagccggttgctccgaaagcaatcatggtaaagaagggaccatcacttaaagcaataatcgatgtcgccccaacatctgttgcatccccatactcaccagcaagtgcggcatacaggccgccattcttgttggtcatcgaagacacaattgctaacgggctcaaccccaagacacccgcaagtccgaagaaatgattaaccagaacacccaagacggcaccaatgccaactttggttatgagcaaaacaacacccttgtagactgaaacacctgcctctttaatactgatctgtgcaccgctacaaaataagaacgctgccagcaatgccatggctccggttttaaagagtgcctctgtaaagccgccaagttcaaaaaactgagggaaaaatgtatttgttaatgctcctaagagcaacggaacgaccatcattccgcccggcagtttcttaaccgtttttaaaatgtgcatcttgctacctccttcttgcattaaatacaatgtaaagcgcttgcaaaaaattctcaaacggaatatgttcaaaatgtgctctcttttgaaacgctcgataaattccctaagtaatttttaaaaagcgtttcaatctgaaacgctcaggaggcttaagatgcttaaaatacttgcaattgcaccgtatcaaaacctgaaaacaaaaattgatgaaatagctgagaattttaaaacactttacgttgagtcttacgttggtgatctgagtgtgggattggctatcgctcaaaaaaaagcatctaaatttgatgttgttatctctcgcggtggtacagcaaaactacttgcgaaatatatagacagaccgctagttgaaattgatctgtcactcctggatatcttaagagtcattcgccttgtagaagtatataaatataactatgcgtttatcggtttctcaaatgtcactgagaaaatcaaacttctaggtcagattcttagcaaagaattgcaagttatcacgatctcatcttctgcagaattaccggaaatcattgcaggccttaagaaacaaggatacagcatgattattggtgataatatcacttttaatgaagctcgaaagaacaatttgaactctattttgattgaatcaggtgatgaaagtattcagaacgcattagtggcggcacgttacctgggaacagaacttcagaaaaggactgaacaatatcgtctaattgacaagactctgatggcatttgatgaaaccattatggttataagtaaacaaggcagtctaatttatcaacacaacaaaaatttctccaaaaaaagaaaccaagccattctccgcgaactaaaaggaaagctcgccaactcgtcaacagatacgctgacacgattttcacgatcagaaggccaactatatagaatcaatgcaaaactacgaaatgcgctctggtttgtattagtcagtccgcttcaaatatcttcttcccaaacggcgccaataagtaattttctccccgcaccaaaacaggatgtcagctcagtcaatattggcaacttatctaaggacatacaaaaagccgcgaaagccaaaagtaatgtgctcctgatcggtgaaaaggggacggcgaaactcgctgcggctgaacacatggcatcactgatcaagcttagacactattggaaaatcgactttaccagaatgacctcaaaatctgattactggcgattgttcaatgacgatacttcacctctactggatcatcattcattgtttattattgacggtgttgaaacattgaatgatgatcaacttaaggcgctgcatagcttttacgcgatgtcggagacgactggtaatatctatatattgatttgtgaatcaaatgacaaagaaattcaaataatcgacctttttcactctgcttttcaaattaccaccgttgcgctgcgccagagaaagtcagatttaggatcactgataagtctgtacctctatcaattctctaagcaacatcgaaaaagtgtggtcggtattaatcaagacggcatgcacattcttgattcatattcatggcctgggaacttatcacaactaaaacgcgttctagaacaatttgttatcaacgcggatggtccctttatttctagtgaatccgtcaagcaaattatctttagcgaagaaaatcgctatattgaaaatcaacgtgacaagggtaccttcaatccactctcgttatttgaaggtaaaacattagacgaaatacaacagcaaattataactattctgttaaaacacaatggcggaaacaagactcaaactgctaagcaacttggtatcagcagaagtacgctatggcgactcttaaaatagtgtgacagctttgttaatgtaattttgcttttaacactggtatgaacatgccaaccatgaatctcatttacgttaacaaacaaatagtgtcaacaatttccactctggaaatcattgacactatttttcgttttctcagtttgagagctatagcgtagtaaagattatcacttcacctttgaggaactttgtgaatacgatatccacatacttaaacagctttttctccaagcaacttacgcccaagcgcacccgctggatggaaaacagcaaaatcctttggcccaaagtttctaatcgatgaaagtgcgcaagcaatcgcatcaccaaccatcaaaacagcagttgaactatttgttggtgctaagttcatatcgtctgcttctgattcaacaggaatcaaaagcacctgatcacacgcttctgccaatgatgagtttgagttgccagtaaaagcaatcgtgtgaacattcataatttttagtgatcgaataggcgcaaggatttctttagtctcgccactattcgaaattaagatgacaacatcgttagaagaaatcattccaaggtcaccatgtacactctctgtcgcatgaacaaaaaatgctggcgttcctgtacttgcaaatgtggctgctagctttttaccgatatgccctgacttccccacacccataaacacgacttttccatggagatcaagcaaggtttggagaatctcagtataagaattgtcaatattttgttctatttcagacatggcatgaatttctcttcgcatgtatttgtgaattaattctgtatattttttcgtcattctagagcatctcccttcactattcgatttttagatcgttctatcatcaaaggcaacaaactttcctttcactttttgtttttcgactgacaagtctctaaaaatttaattgtgaatttataaacaactccgcatcctcatttgttttcattaattttcaatgtaacgaatttgcagaaattgtgggctcaaaaacaatgaagacaaccatcgactcttgtagagccgttatacaagcgcttacattatagtcgtaccaaggaacaggtggtgttgtaaatgatcgaaaaagtgataaatccaaagttgattcaattagcgatcaaagcggtcgattggaaggatgctatccatcaagccgcacagccgctaattgataacaatgatgtcactgaacattatgtcgaaggaatcatccgctcagtcaaggaatatggtccttactttgttatcgcaccgcatgttgctctagctcatgcacctagcaaagacggtgcgaaaaaacttgcaatgggcataacgacacttgtaccaggcgttaatttcagtaatccggataatgatccggttaaatacattttcactttaagtgcaacggacagtacatcccatcttaaggctatgcaggaattggttcagttactgtctgatgacgccttttatcaagtgcttgatggcgctaaggttccgcaagacatcatgaattatgttaataaagcagttacaactatttaattaaggagtggtcaaaatgattcaggctttagttgcttgccgtgcaggcgttggttccagtttaatgttgaaaatcaagttgaatgaggttattgcagaacacgatttaccagttgaagttcaacatgcttcacttgatggtctttcaagttttgatggcccgattgttgtcaccttgagtgatgtagcagatgacttaaaagaagaaggcattcagaaggaaatcgtagggatccgcaacattttagacaagaaagaaatatttgaaaagattaccaaggctctggctgatttaaacgctaaacaaaagtgagaaaacgcgtgacgtaatggggggattaaaagatgcattttctagttagcttactatcaacgccagcaatcttgctggcagtcgtatcattcatcggactttgtgcccaacacaaacacccaactgagatctttacaggaacagcaaaaaccgcaattgggtttctgatcttcggtgttggtgcagcaacaatgaccggtgcgttgcagaacttcaacacaatgttcacgaagggctttcatcttgttggcgttatagcctcacctgaagctgcaactgcactggcgcaaaacaaatacggttttatcgtttcgatgacgctcatctccggatttgtcatgaacctagtgtttgccagaattacaccttttaaaaatgtgttttttacaggtggtcacagcctgttcttcgcatgtgttttagcattagtgctcaaagcaaacgggatcggcaatacttgggccattattattggcggtacacttctcggctttatgtcggctttcttaccgcaactctgccagccctttatgcggaagatcactggtggcgacttccaagctattggccactttaacatgatcggctatgcattatccggtttacttggcggtattttcaaaaaacatgccgacgaaacaaccgaaaacattaagttccctaagtggctttctttctttaaggactttttgatgggtgttgcgtttgtcatgttaattctcttctatgttgctgcgattgcggccggtaaaacagaagtccaaaaaatcgcaggcaccgtagattggttagtcttccctctgatccaagcattgacctttactgccggcatttccgtcctgatgactggtgttcggatgttcttagctgaaatcacagctgcattcgttgctatctccgataagtttattccaggatcccgtccagcactggatgtgccaacaattttcccgttcgcaccaacagctgttttagtcggcttccttagttcatatgctgctggattaatcgcaattgtcattatggtcatattccacttccccatggtcattattcctgcagcacatatttgcttcttctcaggcggcactgctggcatctttggaaattcaacaggcggctggcgtggcgcaattctcggatcatttgttgtcgggctactgttagccttcctgcctgtcctactgtatccaacactttccggtttgggcattaccacttcaactttcccaaatgtcgactataacgttgttggatcattgttgaacggtttcctgcatcttttccattaagcaaatgcttgtcgtcttaagaaaggaagtttcatttatgccacttatgtccggtatctttgtcgcaatggtgacaccgttcacagatgatcaagaaattgattacaaacgtaccgccaaactacttgatcatctcatggcatcagatattgcgggtgtttttatcttaggtacaaatggcgaagcttatctactctccgcagaggaaaaaattgtctttagttcctttgtcattaattatgtcaatcatcatatcaaagtgctggttggtactggtttaaatggtacggctgaaacgattgatctcagtaagcgcgttgctgcattggagccagatgccttgtcacttgttagtccgtactttgtggcgccttcacaagatgaattgatcaaacactacgaagcagttgctaatgctgttaaagtgcccatcatgctttataacatgcctggaaaaaccggtatcaatatcgaaccagaatcgattgctgaattatctgcacacccaaatatcattggcattaaggatagttcaggcaagcttcaaaatctccaaggttatttagacaaacggcgtaacaaagacttctccgttctagttggttcggattcaaagattctcccatttctaaaaatgggtggtgatggggccatcgcagcaacagcgaacctactcacgaagaatgatgtcaacatttacacggcatatcaaaatggtgatttggaaacggctgagaaatgtcagcaaaatattgaaccccttcgaagtgttttgcacggcgcgacaactcctgtcgctctaaaagccgccgtcactgcgtctggcattaatgtcggtccagctcggctccctgctagaatgccagcactgagtgacaaactcagtcaagatattgccaatatagttgagaactacaaggcacaggcaattatctagaggagatagagcgtgagctgatatggagcataagcagcgttgagcgtgatgaccgtactttgtttggttattgtggccaatgcccttatgtgcaggtctctacaccagtaaacacgtttataggaggataaccttgaaaaaatttgatttaacaaaacggatattagacagcggtgctttagcagtcgtccgtgctacccctagtcgcgtcgtcgagattgctgaaagcatcgtcaagggcggcattgacgtcatggaagtgagttacaccaatgcagatgctcccgaggcaatcgatgccgttcataaaactttaggtgaccagattcttgtcggcgcggggactgttttgaacgcgccaacagcaaaagacgctatcgctcatggtgttggttttatttattcgccgatgtttgatactgatgtagcgagtctttgtaatgaatatcaaattccatacgctccgggctgcacaactgtaacagaagcagtaaccgcaatgcgcgctggtgcaacattcattaagtttttcccatatggcggattacttggttcggaagtcatcaagacgattaaaacgcctattccgtatatgccgctccttgaatcaggcggtgtcaccgttgaaaacgttgttgactggttcaaggctggtgttgaagttgtcggcgttggcggggctctaacaaagggcagtataaaccaaatcaccgcgaatgcttccgaattcagaaaaaagatcgattcgtttcgtcatcacgggtgaatagggtgtctcaaaaagccaggtcaacaggacccggctttttgcccaatatcttttctcgtatttaacgaatcgttcctatctttcaaatgggaccgaagattgaagggagcaaccatgctagacattaaacaactacagattatcgatacaattattcaacatccgatcttaactaaaagtagattgagatctcaactaaagcttaccagtagacaaattgactatgccattgaaaagttaaatcaaaacctctcagatcatgagcagtcgctgattgacacagatggtgcctatatcatggttcccaatgatgcctacaattacttgctcacgctccgtgcttcaaaaaacttgacctctcttaatcggtacgccctaagtactgaggaacgtcagctttttctggaattgttattggcctgccgcgatgactatttatctctagttcatcttcagcaatacttgcaggtaagccaatcaacgatttcaaaagacttgaagtcacttgaaaaaacgttgctgaaatcacaacttcacatccactatgatcgacaatctggctacaaattggagggtcaggaaaatcgaattcgttcttttatgatcaaaaccatttctggcgagcttttcaagaatgaatccgatcttttaaacacctgtgcaaatttaatccagcaagttgatgtcccatcatttttaaaaaaagtggctcaaactgcacagtttcatcacattaacttcgtggaaaatcgaatgctggaatttggttacatttttatctttatggtcagtcggctccgaatgaaaccagattacttgccggcgaaggctcgtaagatgaatattgaatcaactaacgaatacgcgttttctcaagatttgctagtccaaaatggcatcgatcaaagaacggcaattgattatctaacgaccattactttgagtctcagcattggcggacttgacgatcttaaactggatcaagagatctttaccatcaccaatcagctggttcaaagattctcggatgtttctggcatagcttttaatgatgtgcatcaagtcacgcagcagatattcactcacttcagatccatgtattaccgactgcaattcgattatcccattattaatccgctcacagatcaagtgatcgaagagtacggtgaaatctttaggctggtagctcaagcattgcgctcctttgagaaccgtcttgggaaagtgcctgatgctgaaatcgcctttttgaccattcatcttattagctttatttactcagctgacagtaggaaaaccgacttggtcactgctgccattgtgtgtccgaacgggatcggtagttcagccttagcctatctgcaactcacgaatctttttccaaacattaaattcttgaaaccatttcggtatgttgacttggaccaacatctagatgaaattgatatgatcttttcaactttttatcgaagcgaattgttcacaaagaaaaaaccttgcttcattatcaacccgattatgacaagtgaagagaaatataatctgatccaaagagttaacagcgagatgtcttcgactttctatgccattccaacgctgggttccatcatgactgttattggccgtgacattgataatccggaactgcttgcaaagattcgccgcagtctaaatgataagttgttccgagcaaaaaccaccaatcgtgaaaaggaattgtcgttggtagatgtcttaaaacctgattatattcaacttaatattaaggccaggacaccggaacaggcgattagcattgcagcctcgccccttgttactgaccaagcagtgactcaaggttatgtagacgccatcattcaaaaacatggtcgaaattcgtttgactcttatatcattgcaccccaagtcgcgttgccccatgctaatccaaaccaaggtgcaaagagggttgccatcagtttcggtgtgctcaatcagccgattgctttcgatgaatcaaatagccgctttgtcaaatatatttttgtactcagtgcggtgaatacaactgatcatttgtctgttttacaggatctaatgaatttattggagaaaccaagttttctgagaatacttgctgaaccagctcaaaaaccagagaatattcttcgctttttaagagagcacgcgcacaatgaatcataaagttgttctacctcttttcagtttacaaagtagttcaccgcgttcgcacccttgtccaacaaaagatccgcagttcaatcgtctgaagtgaccagacgattgaactgcggatcttcattattttgtgaaagtttttggactaatcagaatgcgatcaattcatcactcagccgtcaccaaatccgtcgcatccaccaatcgcttggtaatcgcccacaatttagccacatcttctggccgagtcaagccggttgatttgtcgataatggagctgtagatgtgcggaatgatttgcttcacgccagcgtctaacgcgatttgaagaatagcttcaaagttgtccagatcgatgccgccggttggttccaagttgaagccttcagctgcgcaagccttggcaactgcacggaactcttcttcgtgcttcaggccgcccattgggaagaacttgaagctggtgccgcccatgtcttgcaacagtgcgatcgcggtggctacgggcacttcagcggcagctttttggctgctcttaggaccagtggcaacgttgacaatgccgactttgccagttggggaaactaagccattgatcacggtgtcgttttggcctaacaaagcacggctggtgccaacgccagtgaagacttggttgacatgttgcggctgcaataccttagacacgcggctgaccatcgcactctggttgggatcaccagcgccaaggccgacggagagtccgttttgggttacagcttgatactttttcatatcttcaatcgcagcttcatcagtatcgtagtttttggtcaaaacgcccaccacgacatggccttcagcggcttggtagatatcttcggcgttttggatggaaccagccaaaacgttcagagcaacacggtttttgtaatagtttggtgttaagttcatgatagtgatcctttctatgcgagaatttctttgagacgagtgacaatcaaatccatttcggcctgatctaccgcacggatatcgaattcaatgatgccttcattggcgcgatattcacgggtatagatcgccgggtcgccggctttgagtgctgccgtcacctgcttggcattctttgggctggtggcttcgacagtcaccgccgcgcggaaaattgggcgaccagcgccatcttggacttctttcacattcaaatgcggcacctcattcaaggcggcgacaaacggatgcagccgagctttcatggcgtcaccggattctggtccattgtcgagataatgaatcaaagcagtggtgaagccaagaatgttttctttgccgatcttcatagcgcgaccgatgccgaggctttgcagcttggtccagccgatatacggttctttgccgaagaccaaaccggatgccgggccttcaatggctttggcgccagagaaaagcacgacatcaacgcccaaatcgacatactttttcaggtcctcttcagctgccgcatccagaattaaaggcagatcatgtttgtgagcgacttcgagggcttctggaatggtcaacatgctcttttgaacggcatggtgacttttaacatagaagattgccgctgtctgttcggtgatcatcatctcaatgtgttccggggtgcacatgttggcatacccggcttcgaccacctgaccgccgccaagctcgatcatgacttcttcaggcgtcccatagtcaacattctgaccttttggcagaatgatttcgcgcttggtaaagcgtggcgaaaacgggtggtaggcgtgatacttactgccttgaccgatgatgccggcaacagcttcggcaatcccggcggaagccgaattgaccacaacagcgccttctgtgcctaactttttggcaatataggcgccagttttatcaaccagatccttgatttcaaagaaatggttgtcaccgaactgttgcgcctcaatggcaacctcgggcactttggaaacgccgagaatcgtcattttaccgctcgcattaatcacatgttttaaatcgtaagtcttgtagtagtcactcatacgtgttgttcctccaaatcataaactgtcccgccgacaatcgtgcgaattggtgtaatcagctggtggccggtttcagtgttgccgttggaatccgtcagtgtcttttcaccatccgtcacattatagatcgtgatgtcagcgtctttacccggacgcagccggcctttgttcagcaagtggaaattatctgctggagcaaaggtgaccatgcgaatcacttcaggcaatgtgtagccaacttgcagcattttctccatcgtggttgccatatcgtatactggaccattttcgcggttgcggtggtagatgtccgtgctgagtgacttaggatccagtccgtggtcacgggcaatacgcatggttttgaaattaaaggaatctgtgccgtggccgacatcgaaaatcacaccacgatcataggcgtcgtatatgaactctttgatttcgccatgttcatcaaccatgccatttggcttgccgttgtaagcatgcgtcaacacgtcacctttacccatggcctgcataatgtctttaagttccggcggattagcgcccacatgaaccatgactggcaagttgcccagcaaagcagcgtaagatttagctgccaataatggtttgatgccattatcaatcacaacggaatggctttcgcgcgccttaatcccgacaatgaaatcaggcaagtcgtgcacagcatcaaacagtgcctctttattgaccttgctgatgtcccccaattcatcctgcgccaaaataccggttcgaccaatattgatcagcgcgtaaacattggttttcttatcgcgggtaatgttgtaaaaatcgcgaatgttatcggccccggttgatccggcatcaatcactgttgtcacacccgtcttatagccatcttcatcgggatcatcataatatagcgtcaacttttcataacaatgggcatgatcatcaatccaacctgcactcacataagcttcatgatgcaggtcgatttcttgtttgccacttgcgccttcaagtttgggggcaagtgccgcaatctggctgccattgattccaatttcaatcggttgttcgcgttcggttttgccattcttgattaagacatcaaacactgctgattacctgcctttcaaatctgtgtggaaaatgatttttcgaaacgtgttcactggcgcagctcggctatgcgaaggactgtcaaggcaactggtccaaagaccagaccagttgtcttgactgccgcttcgctacgccgagctaaccgcgccagttcacactctttttgaaacgtgttcgccagcccagaaaccgggctggttcacactctataattttactgggaagaagaagcccataaccatggcgccgatgatggcaccgccggggattggctttttccatgcgtagaagagggctgcgccgactgtactgccgatcccgattggaatgctggcggtgaccgcactcagaatgatcagcgggccaaggaaacgcccggtttggttcccggcacccatcatgacatccgcaccgaatgtggcattactttgattaatcgtaaatttccgcacgaggtaaatgatgaccccgataatgagtcctaataccccgccggtcaaaagggcaagtccaaagttggaaactaaggatttggcaccaaccgagagtaaaatcgctggaatcccaatgccgacaccagttaaaatcgaaccgccaagatcgagaattccgaccagtgagccttccaaaatacgggcgaacaggaagctggcaccaaaggccgcggctgcaccgtatgaaccgccagtcatccccgccttcaacatcgcaacaatcgcgacttcgttgaaagcaccgacaccataattgtaatacattgacgtgccggcaaagacgccagccgacatcaaggcgacgatgacaacgaagccccagtctgcgtgccaaaagtcatgatcatttgcaactgccttcaattcttcatccgcagacacatcatttgctgtggtttgtttatcagccattcgttaacacctctactttccgcctaacatttgatgaacgttcgacaaccaacctggtgcgttcaggttaaaggacttcaacaagttaagatcgaacccacggaagaaaccggatagaacaaacaacagaatcgctgctgccaaaatagatttcgtaatccgagtccaaccgagttcgtcgacccctttaccaatcaaaatgcccaacacaacacctggcaccgcgttacccatgatcatcgccgaaagcccgccgaagacggttccgaataacccagaacgacgaccagcatcaatggcagccagccagaacagaatcggcattaccagattgatcagctgattggcagctgggactaacactttaactgccgtcacctgtaaagattcaggaatggaactggaagtgacattcaagaaagcaaccacgacaaccccaataatggcgccggcaatccccattttcttgggattgtgcacagtctgctcaacattgcgatttttcatcaacaagcctgctgctgcccagttaggaatcacacggtgagtgatatcctgcgtgaaggcaccggcacccaccgttgatgcccatgcattgaagaagaaaccaaggccgaagctaaaatgcgaagccggatcaccttctgctgcattcatttcgcctaatgttcggaaagcccccaaggcttgggttttcggagcggtaaacatccgggcggccccaaccccagccgcaaagccgaccaatccaccaatgatgatcgactggaataaaatcattagtattggcaactcatttcacatcctttaacatatttttcaagttcggtaatgagagtgcgtctggtgacggtgctgtgacatcttcgaaggtcaaagcgccaagatcaatcgcggtaatagcaaccgtcaccgccaaagtaactgcataagtggtcctagtccgtttgaaaaagaagaaaagaaacttttctgtgtaactggatttgatcaacttcagcggctcaaccttttctgggacgatccgtaaaatagcttcatcgccgttgtcgatcagctgcttttgaatgtcgctgaaagcagcagcgaaggcttgttgcttggtctcgcctttaccagatactgtgagaacctgacgtttggtttcattcacgaccgtcatctgaatcactccttaagcttctggatatttcttgttccacgcctcgacaagggctgtacctaaagcttcttgatccataaagccgaaaccaagcactttattgccgtcttcaatcgcggtaattccttcttgaacggaacgcataccatgacgttctggccagccaaactgggtgtgcgctgtgattgcaccagcaccgcctgaaccgcagaagctaatccccatatcggctttttctttatccatcacttgacccaagcgcatatctgcacccatgcctggcacaacaaccgctgtaccaccagctgcttcaacgcctttcgcaacgttctgacccttacccatccgatctgcaataacaactttaaccatgatgaaatcctcctattatgagcgcgcgagcaggaacacttagctcggcgtagcgaagtggcagttacgtcaaatggtccgatctttgggccatctgacgtaactgtccttgacatagccgagttgcgactgcgagcgcgtttgtttattcaaagtaagtgaccttctacaacaattttttaaatcttatcctgcgccgcttcaaaatgaatcgataaaacatacttctctgcgacttccaaatgcccgatatgctgcacaacttgatcagccaaatccaacgacttttgcgaaacttcagcgaacattgtcggatcaaccgctggcaattgctcgcctgacttcgatcggcctagcatttcaatgagatgattcgtgagtacttgcagctgaagatcagtaaaatgaatctccgccgcagcggctagtttgatgacataattgacaagcgctgttgttgcttggacatcactgctttgttcgatcatcgctttgacttctgtgggtaattcaacgttcgcgtccagtggtgtcatccccttcctgtgatacttcatgacttaaactcaaatattctaggatcgcgtgaacttcagcgcgattaatggccaggccgtgatctgaaaatacgtgctcaactgtccccaccagcttaggatcatcctgattcggttttccctgatactgcttatcaaacataatgcgttggaccgcgaggaaaacgtgcatcatgaacgcatcgccgtaatatggatcaattgttgttggcaattgctgcttgagttccgaatagatactgaacatagtcaaaatcgtctgctgcgtctgttgttcaagattgggcttcggtctaatcggcactactggctgctgtgacttaatctgggcaagcggtacttgtaattttttagcaaccgctcctcgaatcgcagcgatgtcagcggcattcggcaacggccgcacttcaatcacctgaacgtccagattcttgagtggaaacacactgatgaccaactcaggatgttcgcgcgcaatcaacgcccgcgcgtcatcaatggaagcaaagccaaccagttcgatgtttggaatcgctgaagcaatgcgctgctgaatcagattggtgatcccaatgccagttgcacaaacatacgcgacccgaaccgtgcgcatctggctatcgcgattgagcgacaccatgaaatgcaaggcaatgaaggaaacaaacgcctcacttaaaactgcctgatcacctgccaactctttattgacggttttttcaatggcttcaaacaaggccggatactcttgcttaatatcttgcgtaaacgggctgtactcaagcaactgacttttcttacccaaggactgactaagatgcaagtacagattttcctgcagctgactgtcgtgactaaaatcatgatcaaccaatgccccaaccgccaagatgatgcgatgtgtcatcgcgaccaagttatgatcttgcggagccactttttcgttaacgctttgaccgagataatagtcgtaatcgtccgtgagcgctggcaagttgtaaaaagccaacgtcctcatgatcagtttgtccgaatactgctgatccgtttgggactgttcaacccgatgatagctgttgactagttgattaaacccttggcgaatcacgccgatggtcaaccgaatgatcgtggcaatcagtgtactaggatcaggcatgtcgccttcctgtttacctagacgaatggcctctttcaagatggtattgaacgcgtgatcaaaagttgcttcaccggtcaaaactaaagctcttttcggttcggttttagtgttcaagctgtcaaccagctcagccatgagcgttttacgattcaactgctgcgtgatgagttgttccagcaagcggcggatagccaactcggtaccattcagcttgtagccataatagtttttgctgatcagcttgacgttgaattgctccaagtaaaccgcgagtttcttcagatcattgttcaccgttgtctgactcacattcacccgcgcctgcaactgctgttgggtggtgtaatcgccggtttgcgaaagaatcaagatcatgcggagaattcgttcattcggggctaaatagttatcagctaactgatcatcgattttctcccgcaaagccgttcgtgcagcttcactagcctcgatccagattcctttgcgcggtgcacttttcaaaactgaatctttcgccgccagccaatctcgaatatctgttaagtcgtacttcactgtccgaacactgactgcaactgactcagccaactgcttagctgtcaccgccccttcagcactaatcagctgcaaaacaatctgccgctgtcggttacttaatgacatctcacatcaccccccacactcaatttctaattctactgtaaagcgctttctaagacgaaacaacaggcaatgtttgcacgattaatcgtgcaacgatatgtgatattgtaaacaaaaagacaattggtctgttccgattgtcaacaatattgtgttaagctattcaggaagccaatgattgaagtgcttatatggcgcgtttatttatgtacataacagcatttataagttgtatcattccttaaatttaaaaaaacgtcaatttcgacatttcacactttgcatcagtcattcgtgcaaaaagccgtttcttatttttaaaaataacgcctattttttggctggtaatctgctgcaaaaataggctgttttgaatgaaagttcgtttgctgcctccgatagatcaagtcgtgcgaaacacaaaaagccatgaaaccccgagtcaagctcggcacttcatggcttttttgaaattaaattcgcacctatcccatcacgattttgttcatccgatcagtgatcaaattccagctgttttatccagctgatggccttcttcattgaagacgcgaatcgcatcattggctgctgcattggtcatgagctgttggaaaatatcgtaactgatggtgacattttctgccccagccttgatggcagccatcacttgtgaagccgtcttgaagctggcgcccatgatcttaatgtgcgtgtcagtactcttgtagaatgaatgtgtctcggcgatcacgctgtatgggtcaatgtccaactgctccatacgattgacgtatggggcaatgtaatcacagtcaacgacgcaggccatgaagccctggcgaacagaataaacggccgtgcctagcagacactcatcgggcttttcagcgcgaatcgctgatactgcccgatagcctggttcaaataatggaatcttaaaggccatgcgcgtgtcatcattatccggaaagcgcttgcgtaattcgtgatagtcagctaacaatttttcctcagtatcgccaaccaattgcacgaacaaaacgcctggcttcaagtcgcgaatcttacctaattgttcgaagcgtggatggccttccttcagcaacagcttgggattggtggtaaccccttcgaactgattaaaactcaacatttctttgacttgatcgaggttcgctgtatcaataaacatggattattccccctaattaaaagcgttcaatggcgatgaaacctgcacataagaaccttggtcgcaatgatcaaagggcggtcatcgcggccaaggccacttatgctccggtttcttaccgcgccggttcacgctcttattattttaattgtagtcccgacatctaattctggatacgtcttttcttccaaataaagcgatcctgcgagctcaggtgttgtcgaaccatcgaaaacaatcgctgtatgaccaaggttgcccagattggtgttcacctcattgccaaccgccgtgatcttataagattgatcgtcgaacgtcatcacatctccgacttcgattggttccaaaattttattgacattaataatgaagcaagacgatcgtaatgcatcaggggcttcatctccaaaaagaatggccatattgatatccttgaacccccgtgcttccgaaccaacttcaagaatttttgtctcgtattttactgtttctgctaatgacgacaccttactcacctctccaataaactaacttatttcgcgtacaagccaaaacttgctaaccaagcaacaacaacacgtggtaccccgtttagaaaacgggaatacaagacagagacaacgccgacttcaacagtcttggaatcagcttcttcaagtcctaaaccaacaggaatgaaatcagccgcgttttgcgtattaatcgcaaacaatgcaggcaatgcatattgtggctggatgttaccacgaccgatttcaaccccgatcaacgtcccaataacctgagcaataacagccccggggccaaggattggtgaaaggaatggtagggaacagataaagccgatgacgataagtccaaagacgttaccagcaagtggcgtcatgagcttggcgaaccagctacctaagccagagccttgaataataccaatcagtaaagcaacaaaggccatgaatggaataacggtattcagcatcgtctgaacggaatctttagccgcctggttaaaagtagcaatcactttcccagcgccaatcccgatacgcgcaatgaaattaggcttcttcatctgcgctgtgatcgttttgttcgtatcaaacttggcttcgcgagcttcagctgcttcttgatctttagctgctgtcgtttttgcttctgttgccgtagcttgagaagctgccgattctgccaatgcagcatgctgtttgccagcttcgccgcgttggtcaaaaggtacgccgtttaatgattgatctggcactgcatcatcaggcaatgccgtaatctgatttacatcaacgtttgaaacgtacaacttaggcacaatatacttcgccagtggaccggattttccggttggtaaaacgttgattgttaaaatatttttctttggatagatcccgcaacgcaatgtaccgccacagtcaatgattgcaacagctgtctcatcttcagggatcgatgtcttgaaaccatcgactgcttccatcccagttaactcaacaatcttgtcaacgatggcaggtcgattgccgccagtcacgtagataaacttatgcttttgttctgtaggtgtaatggtcaaggggccgccatagccgcctgaacctttcacaacttgaatactatgccatttttgatcagccatgatagtaaatgcctcctttattcagacaattaggcttcttgaccattacgcgccgacagatcaactgtcttgctgagcgtaatgccagtttgtttagaaacatatgcggttgtgaagtcggtgacccaaccgccgataaagttcatcacaatcccgactaacatgtagcgaattgcgagatccatttgatttaacccaagtttttggacaccttgggcaatgcccaaccagacgaacaattcacctggattaatatgcgggaacacgccattgctggtatggcagaactgtgcttgtgcagcatagtaacttggcttgtagtattccggcaagaagcgggcaagcgtgaagcacattggattacctaacatgaatgctgctaagaatggcaataccagataacgcatcaacacatttcggctcgctttctgggcaaaccgttcgattcgttcttccccaataaaagcaataatcgtgttcatcaataccaacaatagcaagacaactggtacaatgctggtcatccagctaatgaatgtcttgccacctgtttggaacagcttcatgaagccggctgcaaaatcagaaacatattgcatggtctcatctcctaaatttaaattgtattcttcttaaagacattggttagcatatgcggaatcgctttcatttttatgccgatctcattaaagatcggcagtgaaaacatgctgacacgactcgtatcaaagtcttcaaaactgagattattcgttttatagttcacataattgcgatacgcattcagaaaacattcgcgttctgttcgactcagcttctgcagtgccgtgtaatcagcgccaacttcagcgaccagttcaccgtcaaattgattcacgtctcggaatcggctgaaaaccgtgaggcccttcatcacccgaatttcttgaatacgatcatcatggtctaaaccgatcaacatcaaactgccttggcgaaaacgccgaggatttttcccgatcagcacccgaccatcttgccgtacctcgtgataattgtgagcaaaattacgaatctgaaaatagcccattagtgcctgcagtaaaaacgccgctgcaataaagataccaagtatcaaaacgttcatttaaagtccctccgtgacaacggttaagggatcttgactgcctgaaatcttgcgcagattattcatcgccgcttcattcactgctagtaaaaacagcagatcatagagcatcgataaatcctccaaggcttttttccctaaaacacgtggaatcccaataacaaaaatataactaactgctttgccaccaactggaatggcatgtttcagtacacttagatgcaggaacaagcgattctcgtcaatatccgcaatggcatgggggatcgcgacaccgttatcgagcacaaacttggtggtcgattcgtgcttaatcaatcggtcaataaatcccgggtcaaccaaacctgcatcactatctggcttgagtgctgctcgtaagacagcttcatacgacatacttgctcgattctcgaaaacctgtgggcgccagatgattctgccagcatcaatttcgtgttgaaccgctgaaactcgcactttggtttcaagcacgcgatcccggaagatatcaccaatcatgacgaccggaattcgcaatttatgagccaacggccgatctgtgaaaaccatgatcaactcatcttgatgttttagaatatcttcctcatcctgataagcagtgattgtcacctgcgactcgaacatcgtgttaagctgattttgcaaatactgcagcacgctttgccccatgtttgaataaaaaccaactcgtggttgatctggtacattaacatcggcatgctgcaacgccatttcgaagtaaaccgtcagataattgatctcaacatccgcaatatgaatccccattttttcttccaacttgtcaatcatcaagatcgccatatcggcagctaattgaaatcgttgtaacattttgtccgtcaaataatcagacggagaaatgtggaaaataccgcgattaatcaagaaaattaaatgatacttagtcgtctcataaaattggtcatagtcaatcttggcatcaaccaaagctcgaacttcactggcaatttggtcgaacattgctttgttttcgtgaacctttaccttcaacttagctggtgacaataacttgttcgcatacaagttgaagggaaaggcaaggaaatcatattcttcttggctaaatgacacatggcagcgatcttcaatatcaccaacaatgttaatgaaaagtggtgaatcgtccatcaagttcgtataatacggactaataccactgaatacataatgatgctttttcaggaagacgatgatttgcatgatcttctcaaaaatttgtgttgtgctcgtctttatctttgctgaattcagccgactgacgactgatgcaaccaaagttttatccgtaaaaattcgcgactgcacataatcaaagaggtgattgtaaatcaacatggttaagtcaacagttgacctcacttgtaacttaaccccgcgacttgtcgccccttcaatttggagatcataatttttcaaccaagcgcgacaagcttctaaatcttttaataaagtgccgcgactgaccgtcaattgatcagcgatttcatccataggaatgaattgccgttctttgataagacgaaaaagaatttccgcctgccgcttctgcttgtcgttattatcaatattttgtttgaagacacctgattgaattaaagaaaattggcgataatccaagatgtgcaagaagtaaccatttttattaatgcgaatttctgcagcatccccaagtgattctcctagctcatgaatgtacttctgcatcgtacgcgttgagacgttttcgctttcggccaactcgtctaaatcagatgtgccatttgctaggagatagcgtagaagtcgataatccaaactattcaatcaggttacctccccaagcttatgaattaacctctggacttaccccccgcaacattggttgtcacacctgtaatataactagcacgattggacaagaagtagttgaccaaatcacccacttcactcaatttgccactacggcctaatggtgtagtagacgttgaactgtatccggcacgaattgcatcaacggtggtatcacgcgtataagccaaagcttcttcataactcggtgtccgtaagcctgttgcttccatgatgccaggtgcgacccccacaacccgaatattgtacttgcctaactctttagcccaagaacgggtgaacccgttgatggcgcctttacttgctgaataaacactctgaccaacagaaccttcaaggccagcctcagaagacatattgacgacaaccccatgtccctgtttgaccatccgacgaacgactgcttgtgaaaccaagaagacacttttaacgttaacactgaagatttgttcaaatgtcttaacgtccaattcatatttaccatgtggatctttaggatcaaccaatacccgcggcttgttgatacctgcattattcacgacgccccagatttctccattgagcttctcggcggtggcggcaagattttcaacttcgtcaggatcagtcacatcagtatgcacatacttcaagttagggtccttaaagtcgccttccttgagatcgccgttaacaaccgtagcgccattattaatcaattccttgacgatcgcagcgccaattcctgatgaacctccagttacaacaattgtcttgccatctaaacctaaccaatcagacatattcaatctctccctttcatctttctgctctatggtagcgtttacgagagaaagacttaagacagtcattttccgacgtcggggaaaaaacgtgcacgatggttaacgaaaacaactggatatcgttaaatagtcaactatcacttgaaggtgaaactagtgaaggatcatgtaaaaagagccggttagcggtgcttgaccacttaaccagctcttatttttgaaaacagggatctcgcttgcttttaatatcacgccttagccgcatgacccaccgacttagcattatcctgcccataataagcatccttaccatgttttcgataataatgcttgtccaacaaatactgtggcaagtgcacgtcttgatgtgtcagcgttaatgcgtgataatccatttctgcgacaacttccaagactttggcgttataaactgccttagctggggtcgctccccagctgaatggaccatgttggctgaccagaactgcaggaactgcgttataatcaataccgcgatccttaaaggttttgacgatgactttacctgtgttttcctcgtaagcatcttcaatttcttgttgcgtcaacgcttcggagatgggcacatccccataaaacgtgtcagcggcggttgtattcaggttggggatatccatgtgtgccgaagcgaacgcaactgcccatggtgaatgggtatggacaatcccaccgatgtcagggaactcattatagaggacggtgtgtgtcggcgtgtcgcttgaagggttcagttgcccttctacaacttcgccttgcaggttgacgacaaccatgtcatccggcgttaagtcttcgtaatcaacgccagatggtttaatgacgaacaatcccttttcccgatcaatgccggaaacattgccccaagtaaaagtaaccagatctaattttggcaactgcatatttgcttcgtagacttcttgttttaattgttcaagcatgaaagttcactcctgttcatttattgaatatcgttatttgtcaatcactgactgactgcgttgttttctgataaatggtctatatcaataaacccaaatttaaaacttaatgtacacaatgacctgaaaacgcttttaacgccgccaactctgatataatgggttgtaaccacgtgaagttagaaaggaagtttacccatgcttaaagctattgcccttgatatggataacacgttacttaatagtcaaaaagaaattagtgtcacgaatcaagatgtgctccgctatcttagccgcaaaggtatacgtgtcattctctgttctggtcggccatttgccactttgaagccatttttggatcagcttcatttaactaaaaatgatgatgtctgcatttgtttcaacggcggcttagtccgattagtacgggatcacaccgtcatcaaatcttcaacgctgactaaatcacaaatccagccagtttatgatctcgttaaggaaaaaggtttccacttagatgtggttgctgaagatcaggtgtattcgttaactgaatttggtaaatccagctatgagtccatgattcctaaacaaatgccatttaccgatacgacatttgctaaggtgccagccaaattatcgatttttaaagtggtcatcgctggcgatccagaaatggttgatgcggcttcagaagctgcgcaatcacttgagggcgtcacggtgacaagatcacgacgtaccttactggaaatcatgccgcctaatgtgaataagaagaacggtttgaaagcagccctcaacttttatcgcattccgcgcgagcaattagccgcatttggcgatgaagaaaacgatcaagatatgcttgactacgctggtattggcatcgccatgggtaacgcgattcctgaaatcaagaaaatcgctgatattacgacgcaatccaatgatgaagatggcgttgcaaaattcttgattgattacttccagatcagtccaactgcgatccacccataactcgtctaaagccaccttccatgaggcggcttttttcgtgggcggcgtttgttcatccgttcgtctgttgtgatcaatagctttccatgactactaaactaccggttcctgctccaacccaacccgttcaaaaagatcatcaaaaaaatgtttcgcctttttcacttcagccagcggatcatcggccttttccgtccacatctcaatggtgaacgccccgccataattaaggcgctttaaagtacgcaggcagccttcgaaatcaacggtgccatcgccaaacggtacatctcggaactgacctttactttcggcggtgactggcaaggtatcttttaaatgaaccgaaacaatattatcaatgcctcgttctaactcttgaccgacattgttttccggccaagcagtcaaattgccgacgtctgggtatgcctgcaaccacggactgcgaatttgcgttttgatgtccttaattttggtcaaggcgtttaggaaaggatcatccattgtttcaatatcaagcatgacttctttagacgcagcataagcgacgccgcgttttaagttctcaatgaagtattctcgcgaggtcaccgtctttggttcgtaataaacatcatagccagcaagctgaatgttacgaatgccgagatcaccggctaaatcgattgccttataaagcatttcaaggcttttttctcgaattgccggatcagccgagccaagtgggtagcgacgatggccgctgagcattaaggtgtgcagtctcacaccggtttgccaacttgcatcccgtacttctgctcgctgtgcttttgtccaatcaagtcgggctaagcgttcatcgctttcatcaatcgacaattccaaaaagttgaaccctaaatcgtgagcctgtttcaacctctgctgccatgaatcagtttttgggagtgccttttcgtagattcctagtgagttcaatgttgtgcctccttaaacgcgtttgctggcccagaaacctgcgcacacgttttgtattcgctttcataaatacacaattgctattaaaaagacggtggccttagcaagcccgcgctccaacccttttttcaggctggacaccggctaagctaatggtcaccgccagcttgcttactgtcctatatcacgtttaattcgatacctgaatcacatcaataccttgacggcgcaagtcgcggacgaccttttcattcgcaaagttatctgtgatcaaaatatcaacgccggttaaatctgcgacatggtaattgcttgtgacgccaacttttcgataatcggccacgcagatcactttttgcttggttctggagatcatcgtgctgttgatctgcgcttcgtaaatattttgggttgtcacgccacccgcgacgctaatgccgtcacagccaatcaacgtataatctgactgcatcgtttccagaatctgcatcgcaactgtgccgaccaacgactcttttggatagcgaatttcgccgcctgtcaggatgatggaggtttctggatgacgcacgcactcagttgccttgatattgtttgtgataatcgtcagcggcatgatcgctaactgattaattgcccgccaacacaatgagctggagttgacgaaaagcgtactatttttaacaatataagctggaaccgccgccgcaatcgtatctttaattaattcgatgcctgaacgcgatccgtgattattggcggtcaccacgttggttttctcaaccaatccgtgatgccacttcacctgtcccatgtctgacaaagctttcaggtcacggcgaagcgtcgtgatcgaaacattgaatcgttgggccaagccctcaacagcaactggctcagactgatccaccgctgacaagatcttttcccggcgtgcctgcacattggccattgaatttttcactgtcatcacctctcagcaacgaattgcctgcttgcttacttgccccagatgcggatgatttcgttttggaaatccgttgctgcttttgcaggatctggtgcctgcgtgattgcccgaccagcgatgaaggtataaacgttcacgccttcaaacagtttcaaggtatccacactcaaaccgccagtcacggaaactcggaagcccatatcaaccagcatcttaaccttagctaaatccttctctccccatgagccgccggaaagcaaggcatcacgactctgatgataaatcgcctgggtcacaccaatatccagccacgattgggcatcttctttggtccaattaccatacaattcaatttggatctctttaacttctttttgagctgcttgaatggtcggaatcgttgccgcacagatacaagtcatccagtctgcaccagcatcgcccatgttacgagcaacggttgtccctgcatcagcacatttcgtatccgcaatcacgattttatcaggaaaaagggctcgcaatgcgcgaacggcaatcgtgccttcctgcaaaatcaagatcgtcccggcttcaacaatatcgacaatgttcccaactgcgcgaacatctgccaaagcactttccaacgtattattatctaatgccacttgcaaatttggtttagccaaaatgtttccctcctattatgcggcaatcacacgatctggtcatgtgtcgcacgcctttccttaacgtcaaaagcagaccggcccgtgccggcgtccgatctgcttaatgactcgctttatttcacaagatccgtatcttcacgaacatgctgttctacttctttatcactcataacgttcttgacgccaatcacttgcacgcctttactctgagcgtccttgaacatgtcgacaaagttggttgttgtgaacaccatgtcgtattgtttagccgtactcttgccttctgccaagttggtatgctcaatttgggtaatcggaatattcaaccgtttaaatgctttttgaacactgcgcatcatcattaaactggtacctgaaccatttgcacacgatactaagatcttcatgggaaatttcctccttgtaagtcaaagccttatttagtagcctttttctttgccatattttctttatattgctcgtaatccgttaccatcaagaagtagttcttcggatcgtgacgatattcgagttgtgggatcaagacaaggatcagaacaacaaccacgatgccagcgatgccgagaatcttcatcaagacggtgaagaatggccatacagtgtcccagtcgaacatccccagatagccgccaaacttcgacaaacctatccaagttgaaatcaatgctgcaccgaacacttgaatcaaaccactgaagaacggtaagatcatggctgctttggcaccagctcgcctgtttgcgaagaccccgaatgcggcattatcaaagaacaatgggataaacccagcgataatgatagttggtgaatggaaaatcagtaaagcaccaatggctaggaactgacctaatgcaccaaacaggaagccgatggtaaccgcgtttggttcgccaaatgcgaaggttgcggccacatcgataccaggtacggaacctggcagcagacgatcggaaatcccggtaaaactttcagtcagttccccaacgaaggttcgtaccccaagttgcaggatggtcaagttaaccgcgaacccaagggaagtggtcataatatagaacaggaaactggcatttggtgctaaccctgaggcgccttttgttgctgcgaaaaccccaacgaagtacgatttacccagaatcaacatgatgatgccgaagaagaacagcatcagaatgccggtcgcaaccatgttttcgttaaagatcttgaggaaaccaggcaattcaatatcctcaagacgacgtgcctttttcttcgcttttacttcacgagccttaaacttgtcagccagccaagaaacaaaggcaatcccaaacatttgttgatgggcaacggcaaacccgccgccatcggtcaaatcctgcgtataacgaacggtcatgtttgaaccaactgcccagtacaggcctaaaacaacacccatgaccagcagcacttcaatccgacccatcttcgggaaacagaacagtagaatccagaaagccgttgcagcttgttgcacttggacattaccagttgtgaagactgcccgcaacttcgtccatttctggaaccgaactagcaaaatgttgaagacgaacgcgaacagcagcaacagcatgacatcgccaaacgttcgaccaaacgtcttttccaaaccttcagtaaccgcgttttgcccaaaatatggatcaataacggtagcggttaaattaaagcgatctttcaagccggtcaggatcggtcggaagctgttaaccaagccgccagacccaaccatcaagatcatgtagccaataaccgcctttagaaacccagcgattgattcatataatggcttgcgttccaaaatatatccgagtaaaacgataaacccaatcatgtaggctggttgcgtcagaatattcgacgcaaagtagtcccatattttaactagaaaatctagaatttgctgcatgatttcttacctttccccttcaactccccgcatcgatgagtgctttaaaatcatcaacactattgacggccaacagtttatcgatcagaccttccgtcattaacatgtcggaaaggtcgccaatgttttgcaagtgttgcttcggatcttttgcagctaaggtaaagaacagctgtgcctgcttatcagggtcgtctgaatcgaaaatgacaggctcagggaattttgcaaacccgatcgccgtccccaaaacattctcactttcagccatcgcatgcggcatggccacgccaggcacgatcacgatgtatggcccgttcttctcaacgttagcaataatttcgttaatataccccggcaggatatacttgtgttcgatcagctttcccgcggcttgttgcaaggcatcacgccaatccttagcaggttccggtcgaatatcaacgagatctttctccaaaaagtctttcagtaacatagttgattcacctctcttaaacgcgttcgcagtcgcagaaacctccacataaggacctcagtcgcaatggccaaagcccggccatcacgcctgaggccgcttatgctccggtttctaagcgctcctgctcacgctctctataggaatgcagggaacggtgtgtcgtttggaattgagaaagcatcgtggaaaccgcgatcatacatgaattccatccggtctttatcatctgggaaggtgaattcaccgccaacttgccaaatgaaaggcttaaacttgtattgcaaacgatccttgcgcatttgccagagcgcttcaatttccttagggtcagccataaagttggtccagatatcatagtgaacaggaataatgactttggtgttcaaagattcagccatgcgcaaaatatcgatggaagttaccttgtccgtgataccgcgtgggttttcaccataagcacccaatgcaacgtcaatcttattttcattaccatgcttagcaaacagattggagtaatgagagtcagcagcatgataaagattgccgccggtggtttcaaacagatagttaaccgcaatcttgttcatatcttgcggcatcttgcctgccaacttcacattaggatcgtcttcggtgattaaagctgtccgatcaaatccttcaagtactttgacctttgtcttgccgatagtaaccacatcgccaggtttaacaacaaccgtcttttctgccggaacaccccagccttgccaaatctcacaaaccttttctgggccatagaacttcgcatccggacaattcttattaacagcagcagccgtattcacatccaaatgatcactatgaatatgactcacaaacaaagcatcaacatctttaatggcaaatggatcaatcacaaacggttgattgcgcagattcggttgcatcttctgcacaccactcatccgcatcatctgatgacccttacgcatcatgccattaccatgtgattgcttaccagtgccacaccacatatcaaccaaaatgttggtatcttcagccgtcttcaaccaaataccggtacaacccaaccaccacattgaaaatgtgccaggtttcacctttttgtcagcaatctcctcattcaaccaagtcccccactctgggaatgtgctaagaatccatttttcccgagtgatgttattgatatttttgtctgccatgatatttcctccttaggctttgtttctgctttcaattaacatggtagatgaacttgaatgcgcttacaataccggtatatgaactatataggtcttatatgccattttatgaactttatatgcacttttaccaactatcaattccctattttatgaattagttcgtatttttttagtgcttaaacgcataaaaagcatagcaatatcaatcaacgttggaatcaaatccgacctcacttaaccctcgtcctgcccttattccaaaagtggctgtatcaaactgtctgaccaactgttcacattaagttttacttttccaacacgttaaacgcatatgtaactattaagaaaatagtttcattcgtcttcaaattaagctccattgtcacgtttcaaggcaggctttttgcacgcaaaaaaactcagtaacttcaaagttactgagcttaaaggaggtattaacattaactagtcacattaccttatcaactatgctttaagagcatgattcttggacttcgcgctgttttgtccatagtacgcattcttaccatgcttccgatagtaatgcttgtccaacaaatattgtggaacatgaacatcttcatgtgtcagcgttaatgcgtggtaatcaatttctgctaccacttcaagcaccttggcattgtaaaccgccttttctggtgtagctgcccagctgaacggcccatgctgactaacaattacggcaggaactgcattatgatcgataccgcgatctttaaatgttttaacaataactttcccggtattctcttcgtaggcatcttctatttcctgcttagtgagagcttcagaaaccggaacatttccataaaaagtatcagcggccgttgtattcagatttggtacatccatatgcgctgaagcaaatgcgactgcccatggtgaatgtgtgtgaacaataccgccaatgtcagggaactcattgtaaagcacagtatgcgttggtgtatcgcttgaaggatttaaatcaccttcaacaacctcaccttgtagattaacaacaaccatatcgtctggcgttagatcttcgtaggcaaccccagatggtttaatgacaaacaatcctttttcacgatcaattcctgagacatttccccaagtaaaggtaaccagccctagttttggcagttccatattcgcatcgtaaacttctttttttaaagcctctaacattgaattttcttcctttctatgactgcttttcacttacaccaaggttcttaggcaatcgatgaatcaacttttacaatgaccttattgaattcaatttctttgttgtacattttcttcaatgtatctccgagttcgttcaaattaatttcctgagagatcattgacttaaagtccatttttcctttactcatcgcatcgatgacaatgctccaagctcgtcctgggtaaggcattgtataggacatccaagaaccgtgaatatttagaccgccgcgtaaaacatgctgctcaaaaacatctttttcaatcggcagattgtctccagaaataccgacaaagacaacattgccatcccgccgagtaatctccagtgcctcaatctcagtaaatcgagtaccagcacaatcaacagcaacatccacaccatgcttagtaattttttggacttcagcgacaacatcttgagttttaccattaatcgtgtaatctgctcctaatttctttgctagttcaagtttatcgtcaaaaatatcaacagctatcacgttgcttgcgccgtacagctttgcattttgaatagcaaattggccaattgagccacaaccaagaatggctactgtatcacccgcttgaatatgacctcgagctagtccataaccactgaccgttgcaggctcaatgcccgcagccgttttcaaatcgaccgagtcaggcaaatgaagaacatgcccctttggtactcttacaaattcagcaaatccaccattactacctgttccaatcaagttatagtgttcgctgaatccatataagcccatctttgtataaatggaatcagggtttggaagtagcggagcaactgcgacgtgctcgccttccttaaagcctttaatattggcacccattttcgctactgtgccactgaattcatgacccataatcagcggatacagtctggcgccattttctttttgacttctaggcaaatccgaaccacaaacacctgaataagcgactttgatcaagaaatcatcatcggaaatttctggtactggaacgtccttatactgaacatctccagcactcatcaaaacagcagctttcatcgtatcaaccatggtaatattgaccacctttttaaaatcgtttctcttgttcaaaatcaatttgagaagtgaatactctctttataaatcatcaattatctgtggctgctgtggcattcttagcagcagcacgttctagataagcgcggaaggcatctttattcttctggaaggcagcccacagaactagataaagaacaattgttagccctatccaaaaaatgttttggcttaagaatgcgtaaaaaatcaaaccaaagaatggcttacccaagatattgaaactcgtcaccatcaatgcagctgttggaattgcgacgccaatcccagagcttgcgatatgcgtaaacaatggcgctgttgcagtacacatatacaaccccaagctgaaccaaatgactgaattgatcatggttttaaccatattcccatttgaaagggcaattaagccttcaatccaatacggaatcgccagtaaatcaataactggtaatactttatttcctggtaacagaatagcaagaacgaccataatcggaatcaagagaatcccagtgatgagcgttgcagtttcgccaaaaccaactgcatcgttaacacccaagaaccaaagacgtggcttcttaccttctgcttgattttcagagccttttgctttattactctttcggatagaacgactagccgcttgcgaaagaggtgcaaaggcttgagcaaaaataccagcaattttcgggaaaattgccataatggcactcgtagcaatggcaacttgcgtgatttggccccaagaggctaattcgccaagatgtttaaagttccccaatattcccaagagaaaacctaagaaaaagcctagggaaattggctctcccaagaatcccaacttctcttgtaagtattctgggctgagtttaattttgttgataccaagcttgttccaaacaggatccatcaaaataccgaaaattgccggttccaaattatgcaaggcaatgatggttgttcgcggatagccataataagttgaccagcgttgagcaattgaatctgagagaagcaggctatacatgttcaaaagacacattagaagtaaagagagccacatgttctttgtcacgtagaaacacatcgatccccataccatgtatgagtagttgttccacaaatctgaaggttgaaagacatctgtccaacgaattaaaaacagaaccgtttgtaaaatgaacgcaacgactaggaaaatcatgcccgcttgagttgagtaagcaaccagcgatgccccttgccatccgatatcaaataccggcaagttgacaccagtatcgctaaccatttttttaataactttactaataatcggcgtataggagttcaataataacgtaaatccagtcaacccaacaccagcataaagcgctgaaagaaaggctttctgtgtcttgaccttcaatatcagagcaataaagaacagaattacgggaacgaagacattagctccaaaagtatcgaagaccagctttacagttgttagcattcttacatctccttctatattagattcaaaagcaaatcacaattgatcgtttacttattaccatcaataatctttgctacagtttttttaagttcatcccaaaattcatcttcaccgataccagtcaacagtcctgttccgtttatgacgggcacaccatattcggccttcggtaatgggcttgtgtacacgatcaaatcaaacttaccgccatcaattaactgttttgcctcagtcggacgagcttctgttgctctcactgagtatccttcatcacccaactcatcttgtatctcgccagcaatcatggaagatgtaacggtaccggaaccacagaccgccaacaaattgatatttttactcattagttttatccccctagtgtcttaattattcggtttctttaacagtattggccgtcagcaattgatagatttcatttgcagaattctctgccataactttctgcatcaagtcttggttttgaaaaagtcgcattaactctcgtaaaatcttaacttgtccttttggatcactgactgcgatcataaacatcatgctaacctgcaatgtttcatccggatcaatcatgctgttaacttcaacaggcttgtttaacgttgccaccgacacaactgtttgagaaacaaattcagcttcagtgtgcggaatgccaatgttcatatttgcaagaacaagtcccgttgggaagtccttctcgcgtgcaattacttgatcagggtattcgggactcacaaatcccgccttcaagagattcttagacattttgcgaatcgcctcggcatagctttctgcatcaagatttggataaataaactgttgctcgaatttcaagttcattggatcctctccttctctctaaggtttgaatcgcccttcccagtgactggcttaactttcagtgctgatgcaggcgaaaggaaacgctttcaacgagttcattgtattacctttgctttttgtttgcaatcgcattgcatttatttttttagcaaaatatttgggccgttatagcttatatatagtttgcaaatttatgagcaaattaatataaaattcaaaaaaaaggttgttaattcccataaagtataagttttcccctttctttcggccatccacatagaatcataaaattggctattcattttggaatttagtcaattgtttggcaactcactaaccgcacgctgttttaaaacttttatgctcaattttgcgaattttatgtgcatcttcattgcaaacggtttcttttagctgtaatatacgatttgtaaataacattatgcaaatactttgcaaaggagaatgcaaatcatggaccagacaattgaaaaatcaacggactattcgtctgatgcttatttaaccgaagtcgataaatactggcgcgctgcaaactacctatcagttgggcaactttacctcaaggccaatccgttattgaagcaaccattaaagtcatccgacgtcaaagtacatcccatcggtcattggggtacgattgcgggacaaaactttatctatgcacacttgaatcgaatcattaacaaatatggcctcaatatgttctatatcgaaggccctggtcatggcggacaagtcatggtgtccaattcatacttagatggcagttataccgaaatctatcctaaaattgaacaaaacgagcagggtttacagcgtctattcaaacaattctcttttcccgggggcgttgcatctcatgctgatccaaagactcctggctcaattcatgaaggcggcgagctaggttactcaatcttgcatggggctggcgctgttttagataatccagagttaattgcggcagtggttgttggcgatggggaagcagagactggcccattggcaacctcttggcaagtcaataagttcttaaacccgattactgatggaaccgtgcttccaatactcaatttgaacgggtttaagattgccaatccaactgttttagctcgcgagtcacatgaggaactcacagcctacttcaagggtctcggatgggatccccacttcgttgaaggcaatgatcccgataagatgcatattcttatggcaactgagatggataagattgtcgaagaaattcaaggtatccgtaacaatgccaaaaataatcacgatgagcatcggcccgcctggccaatgttagttttccgtgctcccaaaggttggacagggccaaaagaatgggacggagaaccaattgagggatcattccgggctcaccagattcctattccggttgatcaaaatgatatgcaacatgctgataaacttgttcaatggctccagtcttataagccaaatgaactgtttaatgacgatggcactttgaaagacgatatcaaagccatcattcctaaaggcaataaacgaatgtctatgaaccctgtaaccaacggtggctcgctagccaaacatctagaaaaacccaacccctctgactatgctttagacaataaagaccatggtacaactgaaggtcaagatatgatggttcttggtgcatatattcgcgacctaatcaaattaaacagcaataatcgaaacttccgtggatttggccctgatgaaacgctgtccaatcggttaaataaagtttttgaagccaccaaacgtcagtggatggaatcgacaaaccctccatatgacgcattactggctccacacggccgcattattgattccatgctatctgaacatatggatgaaggcttgcttgaggggtatactctgaccggaagatatggcttttttgccagctatgaatccttcttgcgggtggttgactctatgcttactcagcatttcaagtggctgcgaaatgctcatgaagaagcatcatggcgggatgatattccttcattaaacgttattgcttcatcaacagcattccaacaagatcataatggctattcccatcaggatcctggcgtcattagtcatttggcagaaaagaagaccgaatatattcgcgcctatttacctgcagatgccaataccctagtccgcgttttcgataaaacggtagattcgaaacaaacgatcaatctcattgtttccagtaaacatccacgaccacaatggtttaccgataccgaggctagtaacttagtcgaaaaaggtttaggtattattgactgggcaagtactgaccaaggggtagaaccggacttagtcattgcttcagctggctcggaaccgacactcgaaagcttggcagcaatttcaatcttgcacaaatcgttacctgatttaaagattcgattcattaacgttgtcgacctcctaaagctcaagaaagatgacccccgcggattgagtgatgcagaatttgacatgtacttcactaagaataaacctgtgatctttgcttatcacggctacgatgatctcatcaaagatatcttctttgatcgtcataaccataatgttcatgttcatggctatcgtgaagaaggagacatcacaacacctttcgatatgcgtgttcgcaacgagttggatcgtttccatttggttaaggaagctatcttggatgtatcttcaatcgccgaaaaaggtgcacatcttgatcaacagatggacgatattttgcaaaaacaccacgattttattcgtgaagaaggcacggatcttcccgaagtagaacagtggcaatgggaaccattacgttagttaaccttgagaattaaacttgaacacaaaataaaagaagctctttgtcattgaatgcaggcatctggaatgctcgcaacgatccccgccctgacaaagaagcttcttttttgtctcaatacattaaaaaaatacaaggtactttcgaaagaaaccaagttctattcaaattatcagattgtctacccccatctgtctagctaaatctctattaatccctggatcagaaataataaagtcaacgtcatccagtttaaacatgctaactaatgagctagctccaaacttgctgtgatctgccaagacaatacttgttcgacagtgttgtttcatcgctttagctgtttgagactcttctaaataacggttggtgataccggaaacatcattgatcccgccacaaccgaagaacccaacatcagcatagattgagtcaatggcctgaagcgctatgggaccagaaacagaaccctcatctcttcgaacgacccctccaagcaaaacaatttgaatgctttgcatgacaagcagtgtctgtgctacaaatgttgaactagtaataatggaaagatcatgtcgtggattttgtttaagggcttcagccacctcatatgaactagtccctgaatcaaggaaaatagttgcgccatccttgatataggagagtgcgcgttgtgccatcttttgcttagcttgctgattgatggctttgcgttgatcaaaccgagaagtcggatcgtcaacaatagcttcagcgccacccctaacagcactgaccagtccctgcttcgccaagctatagatgtccttacgaatcgtctcacgtgaaacatccatctgtttactcaaggttgagatcttcacattcctgttttgattgacttcgtttaaaatggaatgtctacgttcatcaatttccatggtttcacctctaagtcttttttgaaatcaattgtaaatcgtttgcaaactcattatatatgtttgcaaactaattgccaaattttaaaatgcaaacaacttgcattcacgtgtcatgcatgccataattgtctcgatgtaagggctttctaacgccaagataaaaggagtaatcgttatgagcaagcgtattaatttgttgtcagtctgtgggtctggcactgttacctcttccatgattgctggcgaaattacagataatctaaagggcgatggctatcatgtgattgccacagaagcgcgaccaacagaagcaaaacaattagttgacagcggcaattttgatttaattgttttcactagtccattgccaaaagcagaatatggtatccctgttattaacggaaccgggttgttaactggaataggtgaagatgagttttgggataagcttaaagcgaccttgaccgatatggaaaaggaaaaagcttgatctcatccgactatttagagcggtaccaactaccgctcttttttgatgctctctccaatgaaaaagtggctagatatcaacctcaagaataatgtctccaaaaaaatactgatctcggttagaagtcgaaatcagcattttgcctatttaaaaagtcgcccattctaaagtcgtaatctataaattcaataactaccatagaaatgtcatctcaacctcgcaccaccaacggcgccaccgccccaatcaagttcgccgcattccgatacttcgccggttccaccactggtagacgaattgtgcgtgccgaaagcgaagttacctgctgatatgcttcgatgccgtcacggatttccttaatcacccgtggttgggcgctgatgccgccgccaatgatgaccttttcgagatcaagaacggtttgcatgttgtagatcatggcggccacaccgcgcgtgaaagtgccgagaatgacggcggcttcgctggtgttgtcagttagtgcttgaaaaacgtgctggccaatcggttcttcgtgcacacctaaggcatcggccatcgcattgatcgtcgccaccgctgacaagcctgccgcggtttgctcgcgcatgatcggggttaggccattggtcaccatgaaactgggttcgccagcaacataatggctgccgtgatagagctggccgttaagaaaaagcgatgcgccaacgccggttcctaagacgaccatggcgctgttcattgttcctgctagattgccgcgccaatgctctgccaatgccgccgcattaccgtcattttcgattaggattggcaccgtaagatcggcggctgtagtcagttgtgtgcccaacaccaatccttctaaaaaaggcaatgtggcgctagctttaacgagaccttgctgcgaatcaatgacccccggtaaagccaacccgatacccgcgacgtgtgctttatgcagtcgaatcaaaccggtcaaactggccatgaaatcagcgagactagcgcgcatggtcggctgctcaccttgttgcgatagtgcgcctgtcgctgacactagaccgtactttgtcgttgtgccgccaacatcaatcgctaaatactgcatagctaactcctttttaccgaattatcttttgcaaaaaaggtcaagagcgatagcacgcatcacgcaatcggtgctttgatgcgtttttcataagcatcgagccattcctgcgtgatcggttcgatcgttgtggtctggttaggaccgggatgtgccatgaggatgaccggtgcctgatgggtcgtggccacactgaaagtgaattcgacattcgttgcgactccccagtgacctgcatgatccatggcgattagggaaaattcgcctgcttgaccataacgacgttgcaatttttcgataaatggataaacggcttcgtcgcaggcttgttgcggtgtgcgaccggtacccatcaaacggacaatttcataggaaagacagcccttcataatgtcttcacccaatccggttgcggcggcaccgccgatttcactgtccacatagaaaccggagccggataacggtgaatcgccaactcggccaggccgcttcatgaaaagacctgacgttgatgtggccgccgccatggagccggttggcgttaacgtgatggcgccgactgtatcgtggccgtcataaggtttgaccttggcatcagcgatttccgctcgtcgtttttcccagcgtttttttgcccgttccgtcaacatgttccgcatttcaaaaccgttgagttgggcgtattgcgtggcgccttcgccgacccgaaagctgttgtaatgctcgtgactgagtgctcgggccacagataccgcatgaaacacattgtgaatgccagcgaccgcgccttgtgccagcgtgtccccatccatgaaagctgcatccatctcgacgacgccattttcattcggcaacccgccatacccaacggatttgtaatatggataagcctccaccattttgatcagttcttcgacagcatcggctgcactgcctttgttttgcaaaatttgactggctttcttcacgccgtcgtgggccattcgccaagttgcgatggcgccccatgtttcgttgctcattttctcatccctcctaaacgtgttcgcaggcgcagaaacctgcacataaggaccttgggcacaatagtcaaaaatcgaccatcgcaaccgagcccgcttatgccccggtttctaaccgggttggatcacgctctgtcaagccgatcatcgcatccataaaaatcatcatatttaacttgagatcagcttcatccatccactcattttctttatgcgcgatccctttttgtcctgggaaagatgggccaaatgctatgatgtttggcatttctcgggcataggttgcgccagtagtggtgaccggtgtgccatcattcccggtcattttttcatatgcctgcgtgagttgcgcaattcgtgggtcatgtttgtcatgcaacacgccaggcatactgcgcacaatcgtgatttggctgccagctggcacggcagccgccaatgccttgctgacatcggcttcgtgataggtcactggatagcgcattgctaagcctaaagtcatcgcatcatctgttttttgcaggctatagggggtcacgatcagccggccactgtcggcatcttcaaacgccatgcctagcccttcgccgaaatgtttttcagccagtgaatcaatgagccactggcaatagcttgctagttcgccggtgaccagttgttccgtcacgagctttttagctagttccgtgatcgcattgacgcctttttcaggggcattagtcggcacgcggatgccgttagcggtgattggttggccatcaaccgccaccgtgagtttatcaggcacatggtcgcgcgtctggtcgcctgcaatggtgccgatctgcttgattgatgtggtcgcaattggggtagtgatgcggtaattcacaattccgcgttcaccataaacgacggggaacttacaatcgggcgtaaagccaaactcaggcggcgcttcactggcaagataccgtgggacatcgtttgacccgctttcttcgtcagacccgaaaatcagtcgaatggtcttttgcggttgaaaaccgacatccttcagtaatttcataccgatcaaacaagccatactgggtcctttattgtccaacacgccgcgcccgtatagacgtccgtctttttccgatagtgcatagggcggaaagtgccagtctgcatcccctgcaggcacaacatctaagtgcccgacaattccgatatagtgctgatcgtcctcaccccattgcacgtatgccatggcatcattgacgaccgccgttttgaagccataggccgcgccgagctgcgcgaccgccgttaaaactgctcgcggccctgaaccaaacggcgcgtgctccgcttgttgaccgcggacacttttgacggccatcacttggcgtaaagccgcgaggaactcgtcgcggtgcgtatcgtacatggctgctaaggttgctttttccatcactctgcctcccaaacgcgttccctgatgcagaaacggccacataaacatctcaagtctaaatgaccacttagattccgctttctaaccgcaccagcgcaagcactttgcgattagtgcgtatcgcgagttaacgtcgacttaaacgagtatttatcggctcgataatacgacgtgtcgaatagaattggcttggcatctgccgtataggtgaccgaatgaacgcgcaacaacggatcgccttttttgccatgcaagagtttggccatttttttatccatcaacatggcttcgacttcttgatgcgaatacgcaattgccacgcgtttttccagaagtgcaaagagcgatccttcaaaatcgtggggctttaatccggcgacatattcatggcagatcgccacatgttcgacggtcattggttcctcatcccagaagcggcgccgcactaacatgtcgatttctttgttaacacgggtatctagtgctaaaacgcggctgatttcttcaggaacggggtcaagcggtccgaagctgatgacttcggtgcgactttttttaccgtatgctttggccgcttctgtaaaaccttgcaatcctagtcgaccgctttccaccttgtcagagtatgtcatgacatacgtgcctttacccggcgatttcaccagcaattgctgccgtatcaataagtcaatggctttgcgaaccgttaaccggctaacgtcaaactcttttgccagatcgtattcagatggcaagcgctggctcgttgtataaacgccatcacgaacgcggcggcttaacgcgtttgcgacatcttcaaattttgccattcatttggcctccgtttcacatgccatttgcaagtgatcaaatagtgcaatgatccgcttaccaacttcagcgtaatcatgcgttggtagattggccagcgacacgcggactgaccaagtgtcactgccaaacggactcgtctttaataacatcaggtgttgctgctgcgctaaggcgactagcaagcgagtcgttgtccagtgttgctttaaatagcgggcaaaaacagcaccatatcgctgtgtgccccacgccagcaagtcaatatcacaataatacgctgtatcacgcgccggtgctggccgagtgagcccaagcgtcgaaaaaagctgctgttctctagcgcggcaagtcgcaactacttcgtctttataagcctgcccttcgtccatcaaaccataaaggctgaataaggcaatcatcacttgttgaacggttgacaatcccgcggcatggttcaaggcgatatcgcgagagtcggccacgatgcggtcaataaacgaaaccgtcgtactttcgctagcaatcgactgatagcgggcggaaacctttgctttaactgctttgggcagctgatcaatcaattcatcgaaaacgttgtccttcgctaacgcaatcgcgccgacccgccaaccggttgcaccaaaatattttgaaaatgaataaaggcaggctgtgttatgcggtagagcggcaaacaaggataagaagtgcggtacaaatgtcccataaacgtcatcggtaagaatcatcaggtctggccgatctgtattaacgatcgcttcgatctgcgaaatattttccaatcccattgcattggcagtcggattacttggattaaccacgaatgctgctttcacttttggatcgcgcagtttttcaatctcggcttgtgggtaaacataactggcgcggtcgccagtcgtcacgcgttgtgccttaatccgaaccacatcaaatgcatagtgaggtaactttggaatctcaaggtatggcgcgaatgttggcagcagcaaggcaatacgatcccctgctgctaataagccggtatgcatcaaggtatcgaacaggtagcaaatgcctgccgttccgccttccactggaaaaacatccagcggcacttgacgatcatcgaacaactctcgaatcatgtaagcttttagcggctgttcgcaaacagaaaggcaccggactggggcaggataattgtcaccaatcaccgcatcgcacgctgcactcacccaagcggctggcgtcatacctagtagctgttgatctgtctgacatatccagttcaagaaatcggctccggggccggggtgcgtcgtcaagaaagtttgtagtcgacccattcgttctggcgcggccttgatctgtttgccaactaaagccgaggacgacttccgagtttcctgaacggcgaactgtcctaatagaaagaatgcctcccgcggcactggggcggtccagtttggattgcctcgaccagcattgaggatcggggcatcaggtgctgactgaatttgcttttccaagtacaaactaagctcaaatgggctgagtgcatcgatcgagatggtcaaggctaatacgctcccttttgtgatctatactttttagtatatactattcgatctgctttcaaattgcaaccgatttctgcaatttctttttgagccaaatgccgtgatgtgtcaggcttcaagcaagacgtttggaaaaatgtatgccctttcaaattttgcttgtttttacaacgacgaccgtttatgatgtgtatgtaccaagcagtatatactaaacccccgctgtcgataccagtttcttttcgtttttgttagcagaaaaaaggcagttgtcagctttacgatcggctgcttttccctgccaaaatatgtggcaataagcaaaattaaataaaggaagtgtgtcatcatgtcaccatctacccctgtccacgaagacaagcgttcgccaatgttagcgcttggcatcttgtcgatttcgttcctgatgtctgtcagcaacgccgtctctggtacgatcccgttgatggagaaatatttctctgatgtctcgcgagccaatgtcgaattgctgatcgtgatttcgactggcggtgtgttgttgggtacggttatcagtggtctggtctccaatctactcggaaaaaagtacacggttattgctgggctatccatttcactcgtttttgggatcattcctgccttcatctttaattatccagcgattttgatttcgcgggcaatgttcggggttggcatggggattttcacgccactaagcgtttcctatatcacggatcttttccctgaagagacacgtaatcgcctgttaggctggcgtaattcagttggggcgatcggcgattccatcatgcttttcatcgccggattcttaatcaacatcagttggcacacaacctacttggttttcctgttcctattggtcccaatcctcttggtgatgttcttcgtaccaaagcattacgacaacattgtttctgaagatggcaaggaagttgaagaagacgttaaggtaaagccgacgaccaatttcggtgttatccagctcgcgtttattttcctccttgtctgcttattctattccgcgatctcactaaaactggcgagctacgttgtcaacaatcacattggcagtgcggcagccgccacgcggatcttcggtttcctcgtcctttgctcaatcttctcaggactgatttttgaaaaaatcgctaaatggttcggcaagtatacggtcaccattttctatatcatcactgcgatttcgatgattgtcatgtccttcaccacttccattccggtgctgttggtgctggtgctggcggcaggcttctgcaatggcatcatcaacccggcactaaccgctcgaatggtgcactattcgccaaaaggttctatgaatttcacgacatccatcatcattattggcatcaacatcggctttctgatcgccccttatttcttccaattcttcggtgaaatgattggcaatgcaggcccagccaatatgattctgtggagcggcatcttctatgttctgttagctgtctatgacctcgttgttgttaaaaaagacaaattgacaatctgatcagcgcgtgagtcaaatcggtcagaaacctgcgagcacttttaatagagcgtgacccatcataacgcgctccccggcgcagcaaccgcgctggctcgcgttcacttttcaaaggagaagaattcatgaatgacaatgtagcatggtttaaacaagcgaagtacggcatgatgatccattggggcctctattcactgctagctggtgaatatcgtggcgaatcttccagcgcttatgcagaatggattcagtcaaaatttcagattcctaatgctgagtatggcaacttggcaaccgccttcaatccgctgtactttgatgccaaaaaaatcgtcgcactcgctaagcaatgcggcatgcagtatctggtggtaacaactaaacaccacgatggctttgccatgtatcactccaaggtcgatgcttataacgtttatgacgccacgccatttcaccgtgatatcattggtgagctggcagaagcttgtcaaaaagccgggctcaagtttggcctgtattactcacaagacctcgactggcacgatccgaacggcggcggctacaagtcgaacgatgtcgaaaccgctggcacgacttgggataatagttgggacttccctgacgaagatcaaaaaaacttcgatctttgtttcgaaaataagatcctgccgcaaatcaaggaaatcatgtcaaattacggtgacattgcaacagcgtggtttgacgtgccgatgaccttgtctgaagcgcaaagtcagacgatttacgacaccgtccgcgagttgcaaccaaactgtttaatcaattcacgtctaggcaatggcaaatacgacttcgtttccttaggcgacaacgagatcccgaaaaacaaagaagacatgaacaagacagacgttgactacaacgaaattactggcttcaagccttcaccactaggtctctacgaaactgccggcaccattaatgattcttggggcttctcgtaccacgaccagaattggaaaacaccacgtaccctttatcgctataagcaacacctcaacgattttggcatcaattatctgctgaacgttggtctcgatccactgggtcgtgtaccaatgatggcagaggagaatctgctggcggctaaggctttggaagatgacgctaaccggtagaaaataaaaaagactgattcagcggaatggctaacctgaatcagtctttttttgcatactatagtctattattgtattttcttaaccaaaaactgatccatcaaactatgctgcgctgtgatcagtggtccaggcaactcattgaacccaaactcctgatacacatgcactgctgtcgccagtgtgtggtaagtttcgagataaactgattgatacccgacttgctgggcatatgccagtgcatggcgcaacaagcgtttgcctagcccatggccttgaagcttgccatggacataaaacttctggagttcagccaccttgtgagcgggatcatattccgcaataccaacaccgccaagaatttgaccctcgcgttctgcaacaaagtattggcgattgggcttggcggcatagaattcgcttagatgatcaagtcctgtgtcaaaatagacagtgccaggcttatctaggtcggccgccttcaagcatttgcgaatcaacgcagccacctgtgcatcatcggcaggcgtgattggtcgaatttcttcattgttcgttgttgtcatggacataccgcccttcagaggtttagttgaaagcatagtattttgactaaaaaatgcaagtgttagttttgaggaccctgattgactctgaaaagagatgccacatgcacctttacaatatgcgatctacactcagtttgtcacattgtcgttagttgcctgacgcgtcttttcttgtctgccattctgtgacctccgccattcattacaaacaagcatgttgtcagtagccattgtcgaagtttttaatttcgtgctccataactgattcgaaagctagcaaaaatggtaatatttttaattgcaaaatatgtcgtcacgacctatactgctatgtgtcgttccgacatatggaggtcatgatgtacgagttatcaattttaggagcactcatgtcgcgtgacatgtctggctataaactgcgtcaagttcttggcagtaatctcgttccccgccgcgagatttccaatggggtgatgtatccagtattgcaacagttacagcacaaaggatacatcaccatgtcgttggctgaaaacagtcctcgtcatgagaaagtcgctcacattacagacattggtcagaagcatttctatgcactaatggctgctccagtaccagtggatgcaaaacgagaatcagtttacctattcaaatttcggtcgttggctgctgtcgactttgcggaacagttgcagattctaactgagtatgaaaacgtcaatgaccaagacttgaatgtgtacacgaccctaaaaaaacacttgcagcaacacaccaaaccggggaaaagcgatcccgcgttgctcaagagtacgatcaacacccttgagctaaacattgcactttgccagacgaaaaaacagtgggtagcacaaacacgcactcgcattttgcaacagcaaaccactgaaggaggcatgcatcatgcctaatgcaactatgaccacgacaccgaagagacatcagtggctggcattgaccgcgatgagcatgggtgtctttatgggattacttgacgtcactgttgtcaatgtggcgttacccacgatggtcaacgacttcaacacgaacttcacgaatctccagtgggtgctcaacgcctacacgctcgtttatgccgtgtcattgttaatcatgtctaaactcggtgacatgtacgggcgcaaaaaagtattccttggttcattgattttgttcgtgctggcttcggcggttaatggtatggccagtagcctaatcgtcttggatataggccgaggcattcaggctattggcggcgccgggatgaattcactctccatggcgctcgtcgcctcgaacttttcaggcaataaacgaggtgttgcacttggtatccttggctccgttattggtatgtccaccgcatcgggtccactaattggcggtttcctagtcgaaaatttcgggtggccgtctatcttttatgtcaatgtgcctgtcggtattgtcgctgtcatcatgacgctgacgtttgttaatgaaacaccaagttatggtcaacacgaacgcattgattttgctggcatgcttttttccggtctcggtcttttttctttaatttacggtttgattatcaaggagggacatccccactggtcatggatggacatccggatcggtggttggatcattgcgggtttcattttgatagcacttttcatctggaccgaaagcagaatccaacagcccatgatgagtcttaacttcttcaaacagcgtcactttgtcggcaccatatttgtggcttttgcactcggcgcaagtctctactctttcaataccttcttgacagcgttgatgcaaaactacattggctactccgcactccagaccggtgttcggcaactaacgatcagtggctggtcattagtccttggcccgataagtggttatcttggtacgcgattctcaaaaaaacgtatgatcagcgcatcattattagttggcgcatgcggtttttttggtcatgttgaatgcgatgggaccacgggtcagttttatggatctgatgcccggcatgctcatgattggattcactaacgggatcgttagcccattgatcaacacggttggaatggaaggcgtcgccccgcaacaaatggggatggcttcgggcttattgaatattttccgtcaactcgggatcgtgattggcgtcgttgggtttggtttgatgcaggcaacccaatacgaaaactatctgaatacgcatatccacaccgtggggatgccgagtcaaatgacaaccggtattcacgctgccctcattaaggcaggtccattctcagggcacacaatcgcatggtcaaaacgtctaacagaaacaccattcgcccagaaattacaaagcgttgtggtgcacgcatacgacaacggcatggctgcagtattgattgcagcgcttgtcgtgatattaattggcagtttggcggccgcagtgttgatgcgaaaagaatcacatgctgacgtgcacgcataggcatcactgaccacccccgcaccagacaaaaaaataagaaaaacaaaatgggatgccggcgaatacttgccagcatcccattttatcgcaactaacggcttgggcaatgctttttggttatccggcacacatcgtctgccccagtctgtacttcagacatggggcttcacaaatgccaatgtttcccgtgaaacattggcccttgtgaattgacggactgggcatgcttgcgccagttgattattcatccgctctcatgccctcgcccctagccaatatatttttcaacaatcgtagttcatcgcgaatcggaatcccattatcagcaactgcgggaatttgtggttttatttttcgagattgatcgaccgcttcgggaaaaagctgcgtcagccgatacccacgccgttgataaaatcctaatgcatgcagattatcgtttgttgtgattaactcaacacctgttttgtggctaagcaccgcagtcgtttcaactttttgaagtaaagcggatccaataccttgattcgcacgcaaactgtctagagaaatgacctcaagcgtgtttcctcgatcaagataggtgatcatgccaaagatgttttgctcatcaatcgccacaaatccaggaagttcattcagatgatacacgaccccactcagaaccatatcatcgctgccccagagctctttaaataatttagttgtcgccgatcgccatcgatcaatcggttctagtttcatgaaatcctcctatcatgaacgatcaagaaatttttaactgtgtcattgatctaactagatcacagcgtataattagcgcatcaataaagtcccgatgaaatgaggaaattgctatgttaaaagatggacttgtcgtgattgatgttcagtatgggttaagcgccgcccaccattacaagcaactgttagcaaatatcaatcagcgtatagacgcttatcacgctgctgatcatccaattatttttatgcaacatactgatgagagcatgccatataacggccatgattggcaactcgatacacagctacatcgtgcaccatctgatcgggtcattctaaagtatcattctgattcctttttccaaaccggtttggctgccaccttacacggcctgcacattcaaaccattgaagtcgccggtctgcaaacggagtactgtatcgatccgcgtcggccatgatcttggcttcaaggcggcgacgatccatggcttgaattcgacctttgatacgcccgatctttcagcacagcaaatcatcgcgcatcacgaaagtatttgggatggttcgtttgctgaagttgttcgtgatgaaagcgtcaaactctagatcagttagtcttccaaaattttgcatcttacgccacccactcctcatggtatttttctcaacatacctcatcaaaaaatcattgtgaatcgttgctcatttgtttgaccacgactaccatccgggtttacaattcggtcgagtttgaaatgtatccgttttcttaattgcagttcatcactttcaatatttgaattggaagaaggtatgaccatgaaagccttatacaaagggcgccctgcctacgtttgggagatcagcaaaaccggtgagcggcccgactggatagaagaagctttatcaaagaacaatatttattggttagataatcgcgtccgtattctcatgaccgcattaaggccaccagtggttaaaaagctaaagatgggcgaaggtggcacgattggtggtggcgttgacgcacttggtgtctacgcatatggctacgtgggcgattttttggatgcaactaaccagcgcgtagtatcgaaagaaagatttttgaaacattatcaaattctaggggtataaagactgaactattacgctatctcactatcatcatcactttcaatgtttgagttggaagaaggtatgaccatgaaagccttatacaaaggcaatccagctgatgtttgggagatcaacaaaactggtgcgcgtcctgactgggtcaaagaggcttttgacgaaaattatctatattggcttgacgatcatcttcgaattttaatgagtggcttgaatccttcattggcgacaaatttgaaaataggcgctgtgggaacaattggcggcggatttgctggctatggtatgtatgcaataggttatccaggcgacttcttagatgtgaccaaccaccgtgtcgtttctaagaaaaagtttctgaaacattatcaagttcaggaaccctaaaaattgagcagcgccactttcaacgtcaaaacgatcgcatcaccagtcttgtgctagtatgatgcgatcgttttctattcttgtgttttggtttgttggtaacaaatgaagcaggttgctgtctccataaaaaacgccttgtccctagtaggctttaaggttcaaacccggagaagatacaagactttttcagtatgcaaaccacttattaattttcatcagcctttttttacagcatgtgccatcagcaaataaattagttcgcacagtatgacgattaaaacagctgcaccaaggacagcgagtgctgctaatcgcgaacgaccggtttcaacgtacccactgccatcaacgcggcgaatgagaatcatgaccgctattggcactgcaaataaggcaagtaaaccattgatgagccagatgcctttatgtttcatatgaacagccccccttgcatagattaagttgggcgactgcgaatctttttgatcagtgcagtgcccgctatgggaatcagcaatgtaacggcggcagccaaataaattaactgcagaccaaagtccattttgaacaaattcaaccctgcagcaacgataaaggtaactgccaataaactgcatgcccaccttatcgttcgttggtgcatgtatcgctgccaccagctaacgagtaaccacgccagcgcgatgaccacaacgtcggaaagcaccagcatctcaggtagcgcgacaaatccaagccgccccatcaatatgatggctaatgctgggccgagccaagtgatcggtcgttgatcatcagtatgtgggactgattgctgatgaaggaggtcatctacggtcagctgataataactggccaatcgacaaatcgtctgcaagtctggctggttacgcccagtttcccagctagatactgttttacgtgaaacaaacaaatcgtcagctaactgtgattgcgtcatgccacgcgctttccgcagttgcttaagtcggctgcctaagcttaaatcgctcattgctgtttcctcctttaacgtaagccatcagttaaaaaagcctagctattatctctagcatccctgatatagcggggtccttcacaaaaatacctcagccctgctctcagacttgaaccggcgatcatggtctggcagacgatcctttaattggtggtgttggaaggatcccgcttaatctgttcaaccttggttctcaatacttgtcgtgcttgatacttctgctcgttagtttatttttttgtcatatggaaataccgttgttttgagatgctaacgcttgtaatgccctgatttgttgtttagtctctgcatgatgtggatatattttgttaagttcattgattttttcagtaatcatgattgcgttgtctcaataggcctattcagcatgatattcagccgctattgtttttgactggatcttagttacaatcatcgctcgtttcacagccttttccactgcagcttcaataacgtaatacatgataaatgcaaagataatcaaaagaaaaaattgactgacatggctttatttcctcaatttgtttgcacaacggtatagtcacttctaatgcttagataacttcattttccatgattgtcaattcatgtgcaacgctttgtggcaaatccttgctagtgatctaactcatatgcccaattcacggtatacaaatagccgccatgcaatgacaatctcattcgcgtggcggctattcttcaattaaaaatccaactatcgtctaacttcacactgtcgcgccgctgccttgttctaccaatgctcgcatatccatagcttcctcaaaccggttagtaatcaagccggtgacgtacggtgcagcaaacagtttcttcattttcagaggatcgtcaatggtccaaacacgctgggccttgttgaggcgcgaattgtaatgttcgatgtgtacggcttctaagtatgctggcagtgatgcccccctgaggacacgactagtgagccaagctgttttcatttttggcgccaaggtgtggatcacattaatgctgtcatgattgaaggaggaataaatgacgcgatcctgcatgttgaattgttcaacatagtcttgtgtcaacgcttcgatacccggatagcggattttgccggttttgaactcaatattgaccatgacgtcatagtggctaagcacggtgagcgcctcgcgcagtgacggaatgtgttcaccattggcgagtcgcatccccttgagttgtgtgcgggtcaaatctgcgatccagccactgccgtcagtcgtgcggtcgacgcgttcatcgtgcattatcacaagatgcccatcagcgctcatctgaacgtcggtctcaatcccatcgatgccatgttcacaggcgtattcaaagccttgtagactattttccggaaaacgggcaggatacccgcgatgcccaaaaattgctactgtcatgttaaccctccaatttgttcattcattgactcaaaataggttgcgatttgttaaaaggttgatgtctctaaatggcgcacctctgcttcaatcttatcgcggacctcacgaaacgcttgcacgacctctacttctgagcctgttgcattagcaggatcaggcaacggccagtgtaggtgctgaacgtttggcggcgtgaccgggcaacgatcgcgtgcatctccgcagagagtgaccactaaatcggcgtgcattagataatccggatcaatcacttttgatcgttgttgcgagatatcaatccctttttccgccatgacttgcacagcgagcggattcaagccatgtgcttcaatgccagcgctggcgatttgccaatcagaaccgaatagtttcttggcgaacccttctgccatttggcttcggcaggcattacccgtgcataagaagtaaacttgcggcatttgttgtgcctcccttagtctgaaaagacgagctaaccaccgttctttaaactgtcttgatcatacgcgggtgaggttgaaacggcaatgaaatggtttaagtagttggttgcatctgggccgccaaaacatgttagtagtcgcagaaaccgcggtgactcacacgctaccgcttataattcaggaggtttccactaacttcatttgtcttctgaatcgctgtattcgtgtcagtttcggcttcgttcagcgcttttttaacatcggcaccgctgtagatttgttgcatagcgagttcaacgttttggcgttcctcttggatgttgctgaagaaggcgccggccgttgcggcattgatatttccttggttaagttgtttgattggcacggccaaagctggattctttttgatcgcggcagccaaggtttggatttggttagctttttgattgactgcgaaatagccagtgccgagttgccaagttgcttgagactgcggtgtcattagaaatttcatgaattgccaagcgccttcttgaacagcggcaggcttatttttagtgatccacaagctagcaccaccaatggccacgccgtttgccttggtgccatctggatgtggtgtgaaagttacaccatacttgaacttcgcattcttttgcagctgacctaacattgctgagctttgcatgaaaatgccgaccttttgcgctaaaaatgctgcactttggttgttcgcagcggcagaaccagtgccaaagttttcaaacgcattttgcttaataacgtcttgcaaccaggtcatgctcttttgcatttcaggcgaattgagggttgctgctgtggccatggctttgcggccgttgtcatgattaacaaccaatgagttctgattagccaccatttcttctggcagccagccgtaaatttgcatcgtcatgcctttgacggcacctttactctttttggtcaaagcgacggctgccttagtaacgtcactgtatgttggtgacaacggtaaatctgcaacgccgtatttcttaaacaagctttcgttgtagtacatcaccgaacttgaagagttgaatggcatggaggcaagcttcccgttaattttataagcggcagttacgccaggatacagctgactcaagtcgtaatgatcacggtcgacaaatttttgaaccggcacggttgcgtttagaccaatcatcatggattggtttgcttgatcgctttgaactaaatcaggcgagacattgctgccaaccgtattcgcgtatttcataattgacagttcataactaccaacgtaaattggtttaatcgtatatttcgtctggcttttattaaattgattaaccaagttctccaatacctgttcatttgggccattcattgaatgccagaacgtaatagtcgtgcgaccagtgccattgtcagcagcctcagtatgttgttggtgcgtgaagaagaagccaaggcctaaaatgacgatcaacgcagcaacaattgcgatcatttttttgtatgtggttttcaccccttagtcccccctgcattcaaattccgcttgaagaatttctggccaatcagtagcaatgccagcgttggcagcaacacaatgatggctgttgccataaccatgccccagttggcaaatgtatcttcagattgcaactgcttcaagccaacctgcacggggcggaaatcatcggagaaggtcgtaatcaacggccacagatactgattccaatgagtcagaaatgtgtacaaggcaaaggtgattaacatgctgcgactataaggcaccgcaattttccacagaaactgcaagcgaccaagcccgagatagttgccaaaatcgactagatcagcgggaatctgaagaaaagcctggcgtagcatgaaaaccccgaacgcggaagtgaagaatggaatggttaggccagcataattgtccaaccagccaaatgccttaaccgtttgaaagtttggaataatttgcgcttcaaaaggcaacatcattgtgaccaaaaaggcgaagaacaattgctttttatagcggaagtttatgaacgcaaacgcataagctgctaatgtacacaacaccagttggccaatggtaatcagaccagcagtgacaaaggagttgatcatgtagcggataatcggcgtggtcacaaatgcttgccagtaattgttgagtgaaatgttggtcgacaggaagttgcctgccgcaatgtctttagttggcaacaaggaagcccatatacctaataaaatcgggaacaacaatgccactgcaaccacggttaataaaagataccgcgaaccatttttgatgtgggtcatgcgtaatacaccttccgttccgtgtaatgaaattgaatccaagttgctaaggcaatgatcaccgtcagcacaattgattcagcacttgcggtcccaaagttgtggaaggtaaacgcgtcttgatagatcttataagccaagaaattggtagcattgtttggcccgccgccagtaatcaaatctatctgcgcgaacattttgaacccgtcaataatttcaacaacaaacaggaagaataaagtcggcgaaatcatcggcaccgtgattttcaaggtctgtttgtactgcgaccaaccagcaatgtcggcgacttcataatattccggtggcacgctttgaaaggcgctaagcaaaatcaggaaggcaaaccccaacgccatccaaacgctggccagcacgatgacaatcatggcgccagttgggtcaaccaataagttggcattcgtcatgcccattgctttcaaagcaaagctagcaagaccaacagacgggttaaaaagaaacagccagagaatggaagctgccgcagcactcgttcccatcgtgccggcaaaagctgtttggaaccaactgattcgccgtagcttcatggttgccaaccgtgccaagacaacgccagcaacaatcgtaatggcagcaaaggcaacaacatagactaaggtgcccgcgagactcttcaggaataagggatcttgaaaaatcgagaagtaattccccaagccaacgaatttcgccgcttccccgcgaatattggtcgcaaagaaactattgtaaacggtcatgatcatcggatagaacgtgaataaggttaaaatcaataaagacggcattaaaaaccaaaaggccggtttattgttttctttgatcgtcgctgcaagtttacttttggattcagttgcggttttgttgagttctttgttaagctccatattcaaccgcctcccgtgctggcgcagcagcggtgattcgcaccccattgttgctatcaaaaagatgccattcatcagcatttgccggcaacagtagattcaggtcggcgccaacagcgatagtaaattgttcgggtactcgactgactaatgtctgtccatcaaagtcacagaaaatcaaggtgtcattgccaagctgttgcaggcttttcacctttgccgtaattgtatctggattagcgatggacactggcaccaatttttctggccgaataccaaggtggtaagaaccagctggcaaatcaaatggtaggacaaacgcattatcagtccagaaggtgtcgccgatactgaagcgatcgccatcgtcattaatggtaattggcatgagattcatctcaggtgagccaataaacttcgcgacaaactcgttagccggatgattgtaaagatctaggggtgtgccaagttgttgaattttttcatcgtccaatacgagaatccgatcacccatcgtcatggcttccacctgatcatgagtcacgtagatcagtgtcatcccaatctcgcgatgaagtcgcgcaatctcttcacgcatttccgtacgcaactgcgcatccaagttggacagtggttcatccatcagcacgaccggcgccttggttgctaacgcgcgcgccaagctgacccgctgttgctggccgcctgacaactcttttggcttacgatcccgtaagtcgctgaggtgcaccagatccaatgcccaatcgactcgcttgcttttttcatcatcattcaggtcctgattttcaagcccgaacctgatattttgcgctacattcataaatggcaacaaagcataattctgaaagaccattgccaacttacgatcttttggtggcaagtccgtgacatcgcgatcattaaaataaatacgtccgtctgttacgctggtcaaaccagcgatcattcgtaaaagcgtacttttgccggaaccagaaggcccgaccatgacgaaaaactcaccgggttcgatctctacggaaacatcggatagcaccttagtattgccaaaatctttggacacgttcgctaatcgaatactcacttctcctcaactccttaccttaatgctaaggttaacggtcatttgtaaaaaaccgcggcaagaggctgtattgtttctgtaagttttctgtaaagctagctatttatgccggaaaacagagatttttttcagaaatagtttaatttttgcgataaaaaaagagcacacctgcttcacaaccaccagttatcagcaagaatggtggttttggagcaggtgtgctttttaacgttcgttcattaactatcaagccacattaatttccatgatgaaccgcaatcaatttctgttgcatctcagccaacttcggcgtgagataaaccgggtaaaaatcaggattaacaagccgctgggtggcttctggcaaggccgctaaagtttcgcgggtatatttttggatcgcgaaaacatcagttggtacatcagcagtgtggccaggtgtgaacaccggttgcaacaatggcttggccgtgaaatcagcaagcgtgacccgtgtctgggttgccaaaggattagcattaacggcggcgattgtttccggtaaaatttcgtctgccaaagcaatgacatcagcaaaagcacgatgactgtcacggtggtataagcgataaacttgtttatgacctggcaatgtcgtcttttcgcgactagcgctgactttgatcttcggctgccattgaccatccgtttgcagagccgccattttgtagaccccactcaaaacaggcgacgaggcactagtgatcagcttttcgccaataccgaagttgtcaatcggtgctccttcttttagcaacgattggatcacagtttcatctagggcatttgaagcggtgattttggcatcctgaaaacctgccgcatccagcatcactcgcgcttgtttagctaactgggtgatatcgcccgaatcaattcggatacccacaggctgatgccctgttgcacgcagctccttgaagattgtgatcgcatttggcaccccggacttcagaacatcataagtatcgaccagcaaggcactattatctggatacaccttagcccatgcgcgaaaagccgtcagctcgtcactgaacgattcaacccaactgtgtgccattgtgcccgcagccggaatatggaatagctgggctgccaaaacattcgacgtgctggcacatccgccaatgacagctgcccgcgcgccatatactgaagcatctgggccttgtgcccggcgcgcgccaaactccatcacaggacgaccttctgccgccgcggtaatccgccgcgccttcgtggcaatcagtgactgatgattcaccaaatttagcaaaagcgtctccagcaattgcacctgcatcaggggcccttctacagtaagcagcggttcccgtggaaaaaccggcgtgccttctggtaaagcagtcatcctgcaagcaagtttcatcgttgcaagctcatttagaaaagtctctgagtaaagattcaaggaacgcaagtagtcgatatcagcatcgtcaaaatgaaacgcctgcaaagcttccactacctgttgcaacccagcggcgatgacaaaactaccgtgatctggaaccgtgcgataaaaaatatcaaaaacagcctgatctgtatgcggcaaggtcgcacaataaccgttggccattgaaaactcgtataaatcagttaacatggcatgattcatattcattttaataaaaccttcttttatgacgtctcaacactaatcgataacggttgctcccagcacatgggcaaaatgatcaagtgcccaatcttgcccagctggtgtcaatgcagcgactgccttctgatgaacaactatctggtaattcaggttgtaggcatccactgcagtatgcaacacacaaatatccgtgcaaacgccaactaaatgaacagtcgcaattttccgttcgcgcaggcgcaaatctaggggcgtcccggcaaaagcagaatatcgggtcttatcaaacatattgacatgatcttcggcttgatgcgcgtcgtaccaaggcgccagcgaaccataaaaagcacgtccccacgtaccgcgaacattatgcggcggaaacagtttgctttctggatgatagggatcatgcggcgtgtgaacatccgttggcaaatacacccagccatcttgctgtagaaattcatcggccaaagcaacaatttgtggtgctagcacttgaccagccttgccacaggtcaaggccccttcgtcagccacaaaatcattggtgtaatcaatgatcagcagcgcttcatttgtgtgtgccataattagtatcctttcttaataaaagtattttttacttaaacttgcattcgataaaagtagatccgacttttatttgctctctacgatacgcggtcacatcggatttttcaactctgccagcttgaaaagcttcggtggccggccactacgcgtgcgatcatgagcagtgccgacttcgataaacagctgttggtgggttttcttaaaattagaattatcaatcgcatttgcagtcgtcattaaaaatggtgcatacacttcgcgcgcctctttcaacgtaaacgtcgtccccaaaacttgaagaatcgtaggctgatagtctagtcggttacgaatacggcgaatggccaccgtcaaaatccgggcatgatcaaacgctagctcagatgtcgatgtgcctagcggaaaaatcgttcgcccattttgcagttgataccctgcttcatcagcagcactaaaagcaaaccagcgtgcatcggtagcaccgtaacccggttgcagcttcggcatcgttggcaagtaagtcatgtaagtcaacgccagtgcgcgctccccgggggtccgcgtcggatcggtaaatgtcgcaagttgctctgtcgatccacgattaacgtgaattccgatcttatcgcgaatcaatcgaatcgctgctgtgtctgcactttcccgttcacgcaaagtggtttccggcaatgcccagaaaccggcaaacggtgccccggcacgatgaatcaaaagtagctgcaactggtgggttgtccgcgaaaaactccaaataacgttcgtaatcgtgatcaaaggatgcgcaagaaattcgtcagccatgaaatcatactttctttataacaattgtgttcagttgtgattatagcaaaacagaggcgggaatgcggataagtaagaacgtgaatgtaatgagatacatatgaattatttcaaaaaaaatacctgctgtcattcaactgctgctcattacttgagtattcgaagaacaacgacagttattgatatgccgtcataagtttttaatttaatcatctcagtagcaatatatttatacttcatgaaaaataatctatgaaactataaatcacttgcaaataatcgctcatttatggttgagatagtgcattgaatgcggttacaattcctttgactggtaccaaccactaggcctatggcgggtgtcggtctatgaaaaagttttaggagggtttttcaatgcataatggctcaagcaccagcacccgtaagtatcgtgtgccacgctctttgttatacagcagcgcaatcctatcactaaccgcagcagcagtatatgctgccagtgcctttgatgtcgcggcagccaaacaacctgttcaagcaacaacaactagagcagccaaaagcatgctcaatatcgtgaacgtaagcaagcaagatcattattttgaagtgacctattcaaatgacctgaaggcgcgtctctttatcttggccgacaatcagttccgcttttacgttgacccttcagaaaaattcgcggcaccggcccaatcgggagaagggttgaatgccaagatttttactaaatcaatcaatgcgtcttcggtaaaagactttgcgtctgctgccttgactagtactagtgacggctggtcgattaaaactggttcgctcgccattaatctaaacaagactgccgctaccttgcaagttaaacgcggcgcaaaggttattatggccgaaagtcagccacttagtatcacagcagacgatactacccaaacgcttaagcataacaacgatcaatacttcggcggcggtacgcaaaacggtaactttacgttaactggcgaaaagatcaaaattgtgaataccaacaattgggtagacggcggcgttgcatcgccaaatccgttctattggtcaacggctggttatggcgtcatccgcaacaccttcacgccagggacctatgactttgatgccgcaaataatggtgaaattaaaacgacgcatcaagaaaaacggttcgatgccgtctatttcttcgatgacaaaccgtacaacttgctaaaagactactacgatttaaccggtgcgccagcgatgatgccacggtatggcttctatgaggcccatctgaacgcttataatcgtgacacttgggttgaagttcctgaaggcaccagtggcggaatcagattcgaagacggcaaattttataaagaataccagccaggaaaagtacccgctggtcaaagcggcacaaaggaatcactgaatggcgaactgaacaactatcaattcagtgcccgtgcggtgattgatcgttacaaaaaaaacgatatgccactgggatggtttcttcctaatgacggttacggcgccggttatggtcaaactaatacgctggctggcaacctaaaaaacctcaaagattttgcggattatgccggtaaggaaggtatcgaagtcggtttatggacacagcaaaatctgtcgccggttgacccaaataaacctaagccggatgatcgcgatttttcaaaagaagtcgctaatggtgttaaagctttgaagaccgatgttgcttgggtcggtgacggttattcttttgggctggatgggcttgaaaaagccgacaacatgatgaaaaaagtcaaaggcgatgacttacggccttttggcatcacattagacggttgggctggcacacagcgttatgctggtatttggactggtgatcaaactggtggccagtgggaatacattcgtttccacattccaacctacatcggcaccggtttgtcgggccagccatacgttggttccgatatggacggcatctttggcggcggaaattcaattgtcaatgctcgtgactttcaatggaaggccttcacgccaattcaactcaacatggatggctggggcagtaatccaaaaaccccattttcttttgatcaacatacgagtgatatcaaccgagcctataccaagcaaaagacgatgctcatgccatataactataccgcctctgcccaaagcgtttttgatggcaagccgatggttcgcggtttattccttgactacccaaatatgcctgaagcttacacggacttggttaagtacgaatacttatggggtgacaacttcttggttgcaccaatttaccaaaataccgcttcagacgatcaaggcaatgatgtccgcaatggcatctatttaccggacaaggatcaggtatggatcgactattacactggtaaggaataccgcggcggtcaggtcttgaacaattttgaagctcccttgtggaaactgcctgttttcgtaaaaaaaggtgctatcattccgactacaccggcacataacacgcctaaggaaatggatcaaaccaagcgacaattccaaattttcccaatggctggcaaacaagactttaccgtctatgaagatgacggtatctctcgaaaatatctaaagggtgcctacgcggaaaccaaagtgacaagcaacctgcaagagggtcagcttgaggtcaatgtggcgcccctgtcaggtgattacacaggtttgaaatccgaacgaacaaccgaatttgctattcgcacgagtggcaatcccagcaatgtcattgcaactgttggcagtcagcaagtcgctttaaaagcagtcaccaatcagaaagactatgatgccggcgaaaatgtttactttgtgaatagcgagtaccacaccaatcagtatctcgaaaagttgaccgacaagaaggctattgaccaaaccttcctccaagtcaaacttgccaaaacaaacgcggcaaccaatgggatcaagttaactgtctctggtattgatgctaaagatgatccgtcaaccgacgatctgccagtgaatgacgaattggcgatcccaagcacaatcaaacaagatgaaaagacgacaacagacaccgcggttggcatcaactggtcgcctgtaacagacgcattaagttacgacgtcaaagctgacggcgtggtttatcgcagtctcaaaaaaccagcattcgttttgtcaccggttaaagaacaaactaagcactcgttccaagtacgaacggtcacaaaggatgccgtatcgaaatggagtgataaacaaacctttagctctgatgaaaatccgttgcgcttagcactgaaaatgaccaacttgaaagtcgattcaaccattaaggatgtcccagtatggcaaggcaaacaaacggtcgataaactttttgatcaagacttaaccaccgaagcccacaccaactggtttaccagcggcgagaagcagtcagcaacgccgatgacgattaccgctgacctagacggtgtctatgatctcgatcatctcacctacgtaccgcgagaaaatggcggcaatggtaatctatcagcattgaaagttgaaaccagtctcgatggtattcattggcatgaagctggtgaaggcaaagggtggacatttgatgctcaagaaaaaacaatttcttttggccaaaaggaaaaagcccagcacattcggctcaccatccctaaggcatcaacgctaggcgactttgtttcaggcaaagaatttctgctatttaagcgtgacggtaccaacaaacaagtattaggcgatattaccaacgatggcgcgattaccggtgatgatcagatgtcgctcgtgaactatgctggtttgacagctaatatcgacagtgacttcaatggttacgttcaaaatggcgatttaaaccaaaacggtgtgattgatgcatttgatatcaactatgtgatgaccaaactcggcaaaacaccagtatccaaaccagatgagaagagtccaagcggcaccctagccttgcagtctgataaaaccacttatgcccctggcgaaaccatcacgctcaatttgattggcaaggatctgacaaacgttaatagcttattcgcccggttgccattaaccaacccaaatgttgatttaattcaggtcgaacccactgctgcaaccgcaagtatggtcaacttcagcaaagtccgcacgcattcgaatagcagtcgcgacctatatctcattttcgcaaatgaaggggaacaaaagcggctcactggcaatgaaaaactggcaacgatcacacttaaagcaaaaacacagttaacgaaagccgatctaagctttgctttgactgatccaatgcttaccaaccagtggggaccagaggctttgccggaagccccagcgccaattgtgctgtgtcctgaagacaattcagagcataatcatgctaaagagcagctagcggcattgattgatgctgtgcatgccctcgatccgaagctattcaccgccaccagttggcagcctgtccttgcagccagtgaaaaagccagccagttgctcaaagatgacgctgtgtccccatctgatctcacagctgcctacattgatctcaaaaccgtattgggcaaactggaagcagatcgcggtgtcaatcaagaccaactgaaagcactgatcacagcagctgcaacactaaaggcagaccgttacacgcccgaaagttatgccaacttgcaaaccgaaataaccgctgcaaagaccgttagcactgatgccggtgcctcacagaaacaaattcaggaggccattcaatcacttagtcgtgcttggtttgcattagtcctcacgcagacacagccgcaatccgacttagcacagtgggtaagagttgcagaagccttaaatcctgaccaatacacgcctgccagctttgacaagttgaccgcagctctagcagaagcaaaaaaggcgcttgctgatacagcaacgtctgctgatacagctcaaaccttgtcaactcaactacaagccgccatcgatgctcttgtgccgcgcggaaataaacaacaactggccgatttgctaaacaccgccgagaaactaaaggcaaatgattatacccctggctcctttgcaaaattgacggaggttttacagccaacccgcaacgttttgaacgatgtcgatgcaactcaagatgcagtgacgaaggcaacagatgccttgagcaaagcgcttcagcaacttatcaagcagccgaacaaggctgaactcgtcaacgtgatcaccaaagcagcagaactaaaggagacagactatacacctgccagttttgctgatctaaaaaaggcattgacgtatgcccgagaagtgaacaaagatccagagacttctggggaaacagttgcaaaggcagtaactgacttaaagactgcgctcgacaaactggtcaaacaaacaccggctcccactcctgataaagaaaagccaagcaataacccgcctaaatcaggcggcttccaaggtgacaccacgattaaaaaggaccagacaaaagatccaaccaagaccgatcatgccagcaacatccccgatactggcgaacatacccaatcaatcctggcactactgggcgcgaccatcatcggcgtactgggttacttgaagctacgacaacctaaaaaagacaaatagctactccatgactcatctcagaaagtgaaacagcttcatgagattgggatagtcttcatagccacaaaaagaacgaatgagttttctcaaataggggaaacttattcgttctttcttatatataaatgaataggatttaaagattccagtaccaaggcggagcaatcgtaggccagatggggctcagccgtgcaaacaacacagcgacgggccttggagctgatgttgttaggcgacttcgagaccgttttttgggctcgaagcgccgtctccgctctagcttcgcgtcgccaccccagctggccggagattgcggagtttggcacggcaaagaaaatcctgtctaacatcttttgtatcccgcgtaaaattgtccttccaaaatcattaacacctttataaatcactcaacctcacaaaaaccgatcccgtttctcctgaaaagcttgcacaataaggtgcccaacctgttgactaaattgcatagccgtctgccgatcataatcaaattgtgtcagcaccaccgcatacaagcgctcaccttcagcggcaaaacaggccgcatcatgttcgcaatgaggcaactcgccagttttgccggctagccaaccgacgaagttttccatggtcggcgctaacagcagcttggtgcggttttgctgatgccgcagggcttgggcacagatatccgctgccggttcgttgccgtccgacattaacaaagcgcgcaatagttgccaggcagcgcttgcggtgatcatattatcgccatcaaaggttgattgcatcaagggtcgccgtagttggacgccaggataatgccgagttagccacgctgcaatggtcggcagcccatacgtggttaatagcgcattggtagccagattatccgataccgtgagcatcaacgtcagcaaatcacgcacgcgccaagcttgtggtgacatgaaacgtaaaatacctgccccgccgaccgattccggaagcgtcacttgccgctcaagttggctgggatcatctgccgctttttcctttacaaaggcggcaatgcccagtttgatcaaactagcagcgggaaatggttgatcaacctgcgcgccaaacagcacatgccgggtatcagcaaccaacaaggcgtgtttttcgtcaaagttctgattcacttgatcaagccgtgtcacgagtttatcaggcgtcatgcataggatctccaattgtaagctgtggtccgtgcgtttgaatgcctgcttgctgctttttgaccatgtagaccgcgtccaaatctgtgaacgtaacattatcatgaaccgcggcaaacgcgatcgccggcaccagactcaggttactttcgatcatacacccaaccatggtcgtcacgccaaaagacgcgcaagctgcatcgatcttcgcagcctccgccaaaccgcctgttttcattagtttgatattgatgtgattgactgcgtggcgactgagtaatgccagcgcatcttgaaacccaaagacactctcatccgccatgattggtaactgtcgcatagcagtcaacgttgccaagccttcgtgattgcgcgcagcaactggctgttcaataaaatctatcggtaactgcaaagccgccagttcggtcaccgcaaccttggcttgatcagttgtccatgcttgattggcatcgagacgcaggcgaatatcagggcctgcagctttggcaatcgttttgacgcgctccaaatcatctgccaatcgaccaccaccgactttgatttttaaagccttaaagcctcgggaaacaaatgccttcgcttcgctcaccatatcgggcagcgcttgaatcccaatcgtcatgtcagtcgtgaccgttcgctgttgaccaccgagcaacgctgtcagcgggatgctaacctgctttgcacgcaaatcataaagtgccaattcaaccgctgcaatggcgggttgctccgatgtgctggcatgaagccgcgtcagcaaactattccagtctcgaatgtcacggccaatgagtgccggtatcacctgtgtctgcaagttttcctgcaaggtcgacatcgtatcacctgtcaccaccgcgttgggggtgccggcgccatgaccaactgtgccgtttgtcagcaaaacgtcaacttgaacagcatccgctgccgtcacggtatgcatcgctgttgtgaaaggccgcaccagcggtaaactgatcggccgtaactgtattttttgaataattggttctaatccggccatgaagtcgccacctcgaaaaattgggttaataactggcgcctaaccgccaaccatgcacgattggcgcggctaggatagattcgattggtcaaacagacaaatccgcgctgggtatcacgatcaaatgctattgatgtccctgtaaacccagtgtgccagtattgatgacgtccttgcgcccaacagcgccagccgagtgtccgaccgcctttacaaaagcggtcaagcagcacaaacgccgctggtggcagaacttgatcgccatttgtcacgggcagaccagccaacaaccgtgtgaaaatagtcagatccgcaagcgtggcgaacaaccctgcatgaccactaaccccatctagtaaaaaggctttgtggtcgtgaactgtcccacgaatgatgccaccgcgagcaggcacgttttcggttggcacaaaatcggctgcagccacgtgttgcggtcgataaccggtcgcatgcatgcccagtggtgcaaaaatatgttgcgtcaggcttgttgccaaatcaccatcgagtgcagcaatcgcccaaccgagtatgatgtagttcaaatccgaataaatcgtctcagtgtctggtgcagcgacagcagccattgttttgatggcatgaatcagccctgcttgatcgagcgcatgggcatcagggacatctgctggcaagccactgcgatgcagcatgagttgttcaatcgtcagttgtgggtagcgcaaaccgctgaccaacgagccaatgggttgggttaattctaacttgccggctataagcaactgcagcagtcgggtggtcgtgccgacaactttcgtcaacgacgccagatcataccgcgcttgcggcaacaacggcagccggtcatccccggcaccttggtagcctatcacatgcaaggcattttcttgcgggccaagcagactatacgacacaccgaaaaccgcgccatcagttatcgcctggttaaccgttggcagcaaagctgtctgcttatttgtgctcatgctcggcctcccaagccgccaaaactgcactgataacaccatcatgatccgccaagacctgcgttgcatcggcggcatccagctcggttttagccatcacaattgcgactgggaccttatgtcccgctgctttcagcaaggttgcagcttggatttgatcaacgccggttgtggccgcaataatgcgttctgcgcgatctaccaacttggcattggttggcaaaacatcgaccattaagttttcaaaaaccttcccggcgcgaatcatgacccctgtcgacaacatattcagaaccatcttttgcgcagtcccagctttcatgcgtgttgatccggtaatcacttccgggccaacaactggggcaatggcgatatccgcatgttgtgccaagacactgtcagggacacaggccaccgaaattgcaagcgctttggtttgttgcgcaaatgctaaagctccgatcgcatacggcgtccggccagatgcggcaatcccgataaccgtgtcattggcgttcaaattcagtcttttgagatcatgctcggctagctccgcagaatcttccgcgccttcaaccgacttgaacatggccgacatgccaccagcaattagcccgactgcccgctctggcggaataccataagttggtacgagttcagctgcatccaaaactcccaaacgaccagaggtgcccgccccggcataaatcaaccggccgccacgattatatcgttgcccggcagcatcgattgccgcggcaatgtggctattttctttggcgattgctggtgcaatttttgcatcttcagcattaatcaacgccaccaaatcaggcgttgtcattgtgtcgatgtgtgtgctggccggatttctttgctcggtcattaagtctgcgattgacatatttttcccctcgaatctttaactcacttgtcaattgtgacgttgcgcgataattctgctcagtttttttgatctcaccttgaacgaccccaagaaaaagaatgttcgcgacataagtctccgtgaacattgaggtcaccgcaccgattcgcaacaacggttctgtcggcggcaaggcaatcacgcaacttgccgcttcacgcaacggactcggctcgtgtcgtgtcactgcaattaccggcgtttggtttcgccgcgcttgctgagccgccaatacgacctctttagtcaaaccgctgtatgaaaaaacgaccatggcatcggccggtgtcgtataataagcgcgctccactgccgtgtgggtgtcgtggtcaaaaatggccacgtacccagcgcgaatcaacttcaaataaagatcctgagccactagggcggaagcactgactcccaccagataaatatggcgtgcctgtcgcagcgttgtaatggctgactgcacggcagattgatccaactcatcaggcaaatcacgcactgcggcaatcgcagtctggcttaatttatgcatcatggtcgacaggtcgtcgtcatcctgaaccagcggatcaagtggcatcacctctgcaggtaacgtcttttcccgtgcgagagctagtttaaacgactgcaggtcggcaaactcaaattgacgaacaaaccgaatgacagatgcggccgataccccgcttgcgtgggcaatctgcgctgttgtctgtgcgataaaagtctcaggatcggttataacatgacgagccaaagcttgattcaccggacttaattgcgacagacgcgactgcaacgtctctaagattgtcttcattcggccttatcaataaaagttgcgatggacgttgcactttcgttgggaaccatttgcgcagtgatggtgactccctgtttcaataagcgccgaataatcgcaatatcgtctggtgatacggcaacggaaggcttgattttcttagtacctggtttttccgacaagttgccaacgttaaaggccttgattggtacgccgccatcaatcaacttcgccatatcgggaatatttcgagtaatgacaaagacttgatcatctgcaaatttgccattctgcaaattctcgatggctttggcaacggagctaattgctagttttttccctgctggtcgggcgattttcaaaccttgaatcgccatctcatcgcgtaccacctcatcgttaaccaccattaagcggttagcgccgactgtgttcgtccagaccatcgctacttggccgtgaatcatccgttcgtcaacacgtgctgccacaattgtcattagaatcttcctttcaaacaacacgggccgatatcatcgcgcccgtgtttttcgcctatcatgattttaaactaaactaccgatccagccgaagatggcgcccagattgcccaacaccatcccgatcagaatcaggacaaaaattagtcgcgttgagttcatatgcttgcgacccagaatccagtatgagaacaaggcaattgctagtggaatcagtgctggcatgattttatcaagcatgtcttgcacgttcatcgtgaccttgccgactttataggtcaggtcaagcttgtagttgataaccgccggaatcatcgcgccaacaaccgttaacccaaggatagaagcaccttccgtgaaagtcgccatgctatccgcaaaggttgttgccagccgggtcccttgtgacaagccaacttggaacaatttccagcgaacccataaaatgaccaagcaaccaatgaccggaatgagtaacccgattggttgattcgacaaagccagatatgcggtgatcgaatagataatcgcattgtaaattgccacgaaaatcgtatcaccgacgccagcgaacggacccatcaagccagttttcagaccagtgatcgctttttcattctcatcgttcattcccaactgatcctgcaaagcaacatccgcgccgacaattaagtgtgccatttgcggcgtggtgttgaagaagcccatttccatgttcagggcttgtttcattttcttaggatcgtctttatacaaccgtttcaaagctggcatgacagagtaggcatagccaagaccttgcattttttcgtagttccatcccaattgcagacccaacacgttttgaatgaaaatctgcttgagatcttttttagttatcttatttaatttcagttcagacatcgatctcgacctcctcatcggaatcatcgccgccgttgctgccgccattgttatggttgcttgggccgtggttattcgattcgttgcgcttgcggtcgttggcatctaaaacatgtagtgccgcgaagacgaagccaaccagcgctgtgcccagcaaggagaatgttttcgtgaaataagccattaagacaaatccaagaatgaaatatggaaaatagcgtttgagtggcagataccgcatcaggatcgcaatccccatcgctggtaagataatcccggctgttttcaaaccaaccatcaaccatgctgggatccaagcgttgatcgctttaacaaccgcggaaccgaagaacaaaccaacgaaaaccggtagcattcgtgaaactgtccacggaataatcccgtaaaggttattgcgctcaacccctttatagtcgcctttttcagctaagcggtcagcgtgatgttggaaaatcgtgttcgtcatccgcgccaaaatatccatttgtgtcagcagtaagccgattggaatcgccaagccaattccataagccgcgccccgacctgacatgatcgcaaaggcactgcccatgatggatccagaaagaaagtcaggaacggttgcaccgccatacgttgcaacccccaatgtggctaattgcagcgttgcgccgacaatcaagccggttttgagatcacccataactagaccagttaccgccccgccaaacactggcgagaataatccgatcttaacagacaatgcatcaagttgtgcaatgcccacatagatcgtcaagaaaataagtgcaaaagcagatattgacatgatctttcccctccctaataggatgtcatgaatcaagtcaattatgccgccatatgaaactgtatttcaagtatttgagtaagaataattgacattgaaattcagtttcttaaaaaacagcgtcaatacgggtgtaccatttttgacgcaaaagctggcgtcacatgagaaacaccagttattctctgtgctacaacagacgcttcaataagcttgttccttcaaaattattttttgaatttaattcttataatgatgccgattagtccactttgcgcagtttggcgacaagagtccgagacataattctcagtcggcaaaataaaagcgaacaattttccacttaaaggaaatttgttcgcttttgcctgctcatggattatttattgcgattttaaagatcgtagtgccaaggcggagcaatcgtaggtcagatggggctcagccgtgcaaacaacacagcgaccgggcttggcgctgatgttgttaggcgacttcgagaccgcggactttgcgggctcgaagcgccgtcacagcgttccagccccagctggccggagattgcggagtttggcacggcaagaaagctttagcctagcatcttcctgcgattattcggaatttagtgaatcacaagtccgatgtgagaattatggttcaccctcagtgaagtctgttattgcagttggaactttaacactaccggattatgatcggaatattgaaaacctgtcgaaacgacatgcacactttcagctttaatattaggcgaaagaatatagccgtcgattaacgtcacaaaacttttacccggttgatacggttgatccaaggctcgaactgacggcacggcagccttggccaagcccatggtcgggatatgaaaacctgcagggagtttggactttgggaaaagatgggtccacgtttcatcgagatcttttgtgtggaagatttcagcggtatcttttaacaagcgatgattgtagtcgccagcaaccatcacataattaccttgcttgtaggcctgctcgatatatttaaacaacttggtgaactgtgcctgctgaatcttgacgttcggtgtgaatgccgacatgtgaatgttgaccatgacgaattgtttaccattcgccaccgtggttttggttgccgtaaaagctcggtccagatcaatgattttgttaaaatcagtgtccactggcaaactgtagcgccgggagctatcaaccttggctttacttaacgttagaataccggacttcgctttgccgatcggttgggtgaacgggtagaacaagtaagccgaatcataattctgaccgtatatattggcgtattgttgctgcgccccagtgaccatcttcacttcattcacatgttgtgatcgatcaccatccggatcaatttcctgatagaaagcaacatcaggattttgcgcctgcgtggttttgatcacaccattaatgctggtacgcacggactttttactgtaggctcgcgaatatttgccgccatccatgaaaaaactataacttggcgggtaggaaccatacccgatattgtaagtcatcgccgtataagtctggcccggtttaaactgcgcactttgttggttcttcacttttagcgcctgatcatcaggcacgcgataataagtggtgaataaataaatcaaatatccgccggcggccaacaacaagacaccgagaatgccgccaacccatttcaaaattcgtttcaccatcgttcctcccaaaatagttgttttgcttattatagcagttgtcttttcctctgagaccagtactatgaggatagacttttttataaaaaggggatcgccatgtcgactgaaactgacagcattttagctgctttcgaaaaattcaacaccattattatccatcgtcatattaatcctgaccctgatgcgattggctcacaaaccggattggccttgctgctgcgtgccgcttatcctgccaaaaccatctacacagcgggaccggccgcccccgatttagcgtggatcggaccacaacaacaagtgtccgccgaagcttacactggtgcactcgtcgttgtgattgatacttctaatcgcgaacgcattgccggtgatcattttgatcaaggagcgatgctgatcaaaattgaccatcatctggatgaagatcagcttggcaccatcaactgggttgacacccatgcttccagtgcatcagagatggtgtgggacttagtacgtcacagcccacagctgcaactcaccaaagcagccgccacagcactctacgctggcattattggtgacaccggccgttttctgtatgatttaacaaccgcccgcacccaccaagctgctgctgacctacttgcaaccggcatcgatgccgccgcaattggccgtcaagaagaccagtttccggaaaatgttggccgcttgattggttgggccttagaaaatgtcaaaatcactgacactggcgccggatcactcctcatcacaaaggccgtgctcgcccaatttggccttgcgtatggcgaagaacagcgcgcagtcggcaatatcggcaagctagccagcattgatcgctgggtggtcttcaccgaacgaactgatggcagctatcgggttgaactccgcggcaaaaccaaagaaatcaatacgctggccgttcaacacggtggtggcggccatccgctggcaagcggcgccgtggcagataatgctgctgaacttcatgctattgaagaggaacttgcatcgttataaggtgtcatgaagaatggtaatggcccagacgaatggtctaaaccccaaagccagagcgatgcctcatttctaatgaatagctgttgtgataacgactggtagacttggttttcaaaaaatacggtaaaatattagaatcgaggaaaagttgacacgtactttggcctgtcaaatcttgtcaacctctatatttatgatatgctgatagcactttcaagaaatctttcatggttatatcaaaacagccgtttcccctgctagggaaacggctatttttcaccactgcgataagtcgtaggcggtatgcgcgtgggttataaccaaatgaacagttcttcgaacgtgaggactgtcttcatttcagtctaagacttttgattgtttacttccgaatgagtacgagaagttagtctaacggattcctgccagacgaaacctcgcaatctcccttataatcaactttttctctcgaatctcttcgcaaaaggaagcatgtacttaccagcaagatcacgattcgcaattgcttgccaccaacttttagggacagcatcctgaccagccgcagctagcaaagacgcagtaatagtcgcgactgtatccgtatcctcgccaagactgactgcagtcatcatgccatttttgaaatcaggtgcgttgcctgccacccaaatggcagcttccaaagtatcaacaacatacccgcttgacttgatggccgacctcggaaggctgataaagtcacgcgcaaacaatcgccgataaactggtagttccgcttgttcagccgccggtaaggcttcaatcgaaaaattaacggccattaacgcctgtgctagggttttaccatgtaacagttgccacaaagtttccagataaatgatgcttccgagcactgcccgggggtggcgatgcgtcatctgggtgtaagcccgataacttttcgctcgcgtgacaaaccgcgattcagtatacaaggcaattgccaagggtgctaacctcattaatgcaccgttgccattcgcaaattcagatggatccccacacatgatcggggcggcacgctcaatgacatatttacgaatcgcttttgcacacgtattgccaatgtcgaacaactttccgttcggtgtataggcaccatcttccatataggccacaaatctgtccatcagatctgtataagaatcaccttcatttagatgatcaatcagtgcaagtgtgaaagacgtatcatccgaccaggtgccagccgcctgctcccaaaaaccgccgccgatcatcataggttcaacgatataagtgtctcgatgtttaaattcataaggaacgccaaaagcatcaccgacaatcgcagcctgaagcattcgcaaaatccggtctggcatcatccttttcacctccaattcatgtgttaagtctatcacgtcatcgcgatcattttagctcattcgccgctcgtcactttaattccaatgatcccaatcacaagcagtgcgatgaagaaccaagtcgctggttgcagttgatctttaaacaagaccacaccaacaataatcgatccgacagcgccgatcccggtccaaaccgggtatgccaagcttaatggcagatgtttaacggcaagggccaagaaccaaaagcttaaaaccatcccggccaaagtcgctaacgtaaatcccaaacgactaaagccatgcgacattttcataaaggttgcccaaacgacttcaaatccacctgctaaaactaaatagaaccactgcatgaatgtgtcctcctcgtatcattttgcagcctcaaaacaaaaaggcgacagtatacgcaaccgctgcattgacctaatgcggttgcgatactgtcacccggtagtgactgctatttaaataaatgttgatgttattttttcacatattgacaacggcgtcaaggaaattgctaaaagttccgcgcaatgacccacaaaatgatgagttgcgcaaatgcgaacgaccaagtaaaagccagcgcccatttgctatgttcaacaaccatgagatgcccggcaagattgccaatcaccaccaatgccattacaagccacaacaacgctcttgtacgatggtcgattggtccctttgaagtgcgcatgatccagaaaataatcattgatatgattgaaacacctagtaggacaccaatgatgtgtaccataactccaccccatttcaaacgcgtaacttagttgttttgcgacgcgttctatttgttatcaaacgcggactagagatctgttatatcttacgcctgcaatttacagcggattaatgccaccgtcaatttttcggcctgatagttaaacctgattcgccaatttctgaatcactgcagcgaattgttcaggttgcgcgcgatttaactcatgaccgccgggaagatgcgttaaggtcgcatttggcatgatctgggttaatcttttcgccgcgcctcgattcgcgatgtcccgcgtcccgcaggccactgtaatcggaactgtcacagtggccaacgccgatgttaaatccagtgccattaaggataccgtgagtgattgcacttgttgcttggtcacacctagttcagcaaacgctgttgccggttgaaatcgaaacatgacatcttaggctttcatcagtaaacggttgggtgcctgaaattggggcgcactgaccaccgcaccgataatttttgtggccggcttaacaagctgcatcaaggtcaaaactgcccctaacgacaagccgcaaagaatgactggcgtttcacttttctgtaaatcggcggtcagcttcgcgttcaatgttgttaatgtcattgaatcatctgacttaagtctggcaaacacatcaaacgtccggctcggcagccgcaattaacgctgaattggttgccatatgttggcagactgtcccagtccttgtatcatcacaacttccatcatgccctccgaaaagattttttggttaatcactctcaaaacgatcgcacctaacgccccgcataccgatacatgatccacattaagaaagcagcagccaaccataaaacaatcatgccagctaacgcaaacaatctaaaattcgaattagctctggagccaacctgaaattgttgatcaataatgtgtggatggaaaagcgcacctaggaacggtaaaaaaccaggaagaaaaatatttattttactgccccaaccatcaatttgtgctgcgccattccaatgcgtgggaattttttgaggtaagtgaggataaatcaacacggcaaccaccacaagaccaataccgataatgaagtttaaaacgtacatacagcagaaaaaatacttaaaccactttgtgtgaagcattgataccccccctgccccaattctcctgcaactctactgctacagtactccttaaccatatcatatctccacttgatccaaggcaccattttaaacagctttgccaatcatcagctctgtccatcccagcacaaaacccgctctaatcgcaacattcattgattgcacatgggagaattgggtcccataaagtggcaagacatcttggtgtcgatgctggatttcagcggttagttgctgtactaaccggctggcaatgccttggtgacggaaggcagggtcaagcagctcaacgccgatctcccaacagtacctgccattttgactggcgcctgctacggccacgaggtctccgtctagttcgtagccaatcccaaggcgatccggtgccgccggatcataaccaaacgccattttgatcgcatgatcggcttggtatttcggaatcgcatccgcttcaatcaaatgcatgcccgcggttaattggcgacttagctggttactcggcacgaagaaaggtgccatattggtcacttttaacccaaaattccgaagcaattcggtgagttgctctacggttttcatttcaaggaaccacgccccgtctgcctgtccaaaagcatctgctaaggcagctgtgacctctggcttcgttgtgcgcacccatagtcgtcctttgcgaatgacaatgtcaccaacatcacgcgcccaactgcgggcagtcggcacaggcggtctagtcacgaaaagatttcctgtattttgcagccgcgatgctggcacttgcaaatcctgtgctaattgtttcgtgataagtgacatctcatcctccagatttaaaatgttgggcgttacttttcaagggtcttgcttaaccatgacacgttcgcgaatcgtcccaaacttggtcgtatcttccataatctgatctgtcacgctaaagccaaaatgctgatagaatttctgcgcagatacattattatccaaaacacgaatataaaactggtcaaatttctcatgcaggcgttgtaatgcccgcgtcatcatgacagcaccgacacctgtatgttgaaactgcggcagcacataaattgaataaagctcaccccagccgttaaaatccggcaaccgcgctggaccaaagctgcaaacaccaacaattttatctttgtcatcaactgctaacagcgtgtcttgccagcgccgttccgggtgccaactggccggtgagagttgcgccaaaaagtcatctgatatgagtccgtggtatgcgtcctgccacgtcacgtagtaaacctgccgaatagcatcaaaatcagagttagctgtggcttcaataaccttcactttagcagtcattctcttcgcctcatttaccgttaccttgctgagccaaaatccaagtcgcagcatccgccaaactggcacattcaacaaacgaacccgccacctcttgataacctgcatctccacgccctgttgcgacatgaatccccaagatgccagcattaatggcacattgcatatcagccagataactatcaccaacgatcacagcatcacgattcgcaaaacgatagcgaagatgtgcttgtgcaatcagaccggtcttaggttttcgacatggacatccagcgttctcagcatgtggacaaataaaggcatcagaacatcccatttcaagtaacgagatgcgcagcgcggcttcgtccaactgaccagcagcaatttttgtctgattcgtcagcgcaaaaacttgcaacccagccattcgcaaagatcggatggccgccacactgccgggataaggttcgaattgctgaatcgccgtaaaatgaccgtccccgcctatggtgccatcgcgatcaatgaaaactgtcttgatgaccaagtgtgaggctcctttcagtcgtatcaaacaactaattccattgaattgctttcattatatgtcagtgatgcgtttccaaccatccgaacattttcgtagatcaatatcatccccacatggttcatggtgtgtttttttaagcgacaccttgataattgactttaaaatgcaagtgctctatattccttgttattggttcaaaaaaataaaccattagtcgaggaatacatcatgaccaaaaccatgcaggccgcgcttatcacgcattataaacaggctgtgcctgaaattcaaaatgtccctttacccactgtgcgaccaaatgatgttttggtgcgcattgtggcagcaagcattaatccaattgatctcaaaacgaaagacggcaagctgcgactattattaaaataccagatgccattgattcttggcagcgatttttcaggtatcgtcacaaaagtcggaaccaacgtgactcgttttaaagtcggcgatgccgtttttggccgaccacaaaaagaccggatcggaacatttgcagattttcttgcgattgatcaacacgatattgctttgaaacccagtcggctgacatttgaagaagctgccgccttaccccttgtcagtctcaccagttatcaagcgctacacgacttgatgcacttaacgcctgatcaaaaagttctgattcaagccggagccggtggtgtcggtaccgtcgcgattcaaattgccaaagcccttggtgcagaggtcgccaccaccacgagtagtcagaatatcgcttttgttaaatcactaggcgccgatcacgtcattgattatcaccgtgtgccatttcaggatgttctgtcggactatgacggcgtttttgacacactcggcggcaccagtcttgcgaatgcgttccaaatcgtcaaacccggcggcatgattgtcagcgtctccggcatccctgatgaaaagtttagcgatgcttataacgtccctatttggaaaaaagtcgcctttcgcttggcaaatcaccgtatcagcaagctcgctcggaaaaccggcgtctcctaccgttttctatttatgcatcccagcggatcagaactggaaaaaataggcgaactcgtcgaaaatgacaaacttcgccctattgttgatcgcgttctcccatttgctcagcttcctgaggcatttgcctattcacaggctggtcacaccaaaggaaaaatcattttaaagctggtcgataaccctaactcacttttgcaggtataaatcgcgaaattgtgcaatctcacctgctgatagcttaagtccttcgcgtaagtattgctgaaatgacccaaattgctgatcaattacttgaaaataacgcctcagataatccgcatcaactttcagggcttcgccgattgattttaactgttgatcagtaaaaccccgttctttgagtccagcaagaatctcttcattggcgactgtgcgctcagcattggtctgaagataatcggccatgatgtcttgctcgctcacgtccagtattttcaaaatcaatgcggcgccaacgccagtgcggtctttgcctgcaaaacaatggaaaatggtgggttcgtttgggcgcaacaaaccttgaataaactggcgatacccagtcttggccgaatcactcagcgctaactgctcataagtcgccagcatattttcgtgaacattgcccttctcggtaatcatgcgcccaaggctggcattattggcggtcgcatccttgagaatgtccaacacggcatagtccgccccttcccacaccgtgtccggaaattccgtccgctcgtcgtcactgcgcatatccacaatgtgcttaattcctagcgtctgaccaaggtactggctttgatcatcctctaattcaaaaagttgtccagaacggaaaatcaatccatccttcaccatttgaccgtgagcgttctggtacccgcctagtgaccggaaatttgtaatctttttcaacgtcacgatgccccttcctgttgctgcggtgaaacgacctttgccggctgcttttggggaaacttttccaaacgataaagctgctcatcgtccacagtttcgtgccccttcttaaaggcgtaacccatgtgccggtaaaaatccaccgcagtaatcgatgctggaatctcaacccgttctgcttgcttaaaataggtatcctgctccagtgtgcgaataatcagctcgccaatgccctgtccttgataggtcggcagcacgaaaatatcaaaaagactatattcagtcttactaccccaatatgaaccaatcgcaccggtaccaataatacgattgccatcatgcacaatgtagaaatgagtttgttcggccttatctaagaaaaactgtggcttcattcgtttaacagttttctcaagataagccgcagaatagtcgcgactattggagatatttaacgtagtggcgaccatttgcgcgacttctgctgcatctgctggtcgaaatcggcgaatttgaatcataactgatcacctcacgaaacaattttggctttatcaagttgtgactaatttatcacacttattcatccattagggaaatatcgttatgtttcaccgtggttgttgccagaccagcacgtcttctaattgtccagttgtctcatcccgatcttgctttaaaagcgtaaagccatgtcgacggtagaaacgagctgcgcctatgttcttctgataaaccgctaacgtcagcttaggataggtctgttgcagtttggccatcaacgctgcccccacgcctcttccgcgggcttgctcatcaacaaagaaaccagcaatgtagttatcttgcaggccacaaaaagcaatgatgtcatgatcacgctgatcctgaacaagccaaagtgttgccttgctaatctgatcacgcaccagcggcacatttccagtccaatagtccgctgggataaaatcatgggcctgcaaattaccttgtagccagatcgccataattcgatcaagttgcaggggtgttggctgggttactagttgaatcgtataagttatcatcttaacctctgaattcactgttttcatgtgaaactttagctgcatcgtaacttcaagccatcagtgccgcttttaaccaattgctgtcacattcgcaccttttttcccattaagcagttgcgaaaagatgtcgtaccgatgaaggcgcggtgttctcgaatcgtactgtagcccatcgccttaaaaaacggctgagcggtgatcgaaacataagctgtatactgcgatgacacgactcgttgctcaagtgccgccactagtcgtttgccgaccccttcacgctgatgcgccgcactgacgtaaagccgatccaagtagccatcagacgccatgtcagcaaacccaatgattgtctcggcttcatccaatgctaccagcgccacgtgtttcatgaagctggcatgccacgccgcaagcgatcgctcatggccagcccaaacggcaatctgatcagcggtatagtccttcgcgttgattttttgaacggtgtctctaaaaagcgccaaggtaggtgccgcgtcacttggctggtaggatctgattatcaacaaacgactcctttttgataggcactttggagcggtgtggcggctggcaagccaattgcctgcttaacttgggcgaaaaatgtttctggtgtcatgctcaaaaccccgtttcttcttgtcaatatcaaatccagctgattggcttactcggctgtcaactaaaagtcagtcaatgatcctcattgttgtccctatttatgatatggactgccaatattaatcataaaggcccgataaatctgttccatcaagactaaacgcatcaattggtgcggcatggtcaacttgccaaaactcaaagtatcattggcacgtttcatgactgcaggcgacaagcccagcgacccaccgatcacgaaagtaatgtcggaatgcccataggttccaagatcggcgatttctttcgcgaaaacttcggatggccgctgcttgccttcaatcgccaaagcaataacccattccttatccttaattttgcctaagatgcggtcgccttctttagctttcacatcagccatctcagcctcggagagattctctggggctttttcatcggcaacttcaacgatcttaaccttagcgaatttatccatgcgctttaagtattcagcaatgccgtcgcgaaaatacttttcctttaatttacctacgccaatgatcttaatgttcatgttggtatgatctccatagtctcgttgtttgaccgatttttttctgtttcaagtataccagacgttctgggtcgaccagcaatgcatccaacaacaaactggttgggatcgttgagagctgatgtagggacgcccaacaaaaataaaacggctaagccgctcgcgtatagttgcttcaaaacgcgttcgcaggcccagaaaccgggcctgcgaacgctctgcctgtttgcctattgtcaacgttcggattatggcgcaaaatagtctggttgaggtttttttaatgaggtaaattgatgattgttattcagcgtctgatcaaagatcgggtcctgcagatcaccgccttgttggtcgtcataagtctgttcattggccggccaaaagcaagcgacataagttttgccacattatggtcaattctcgccatgatgacggtgattcaaatcttcgagcacctacatattcttgattactgggcctatcgactgacttcccgggcgaaaaacacgcgacagttaacgtggtggtttctttttcttgcgatttttgccagcatgtttctttcaaatgacgtgaccgtcttgaccttggtgccgctctatctgcgggttgccaagaagtatcagttacccgagattctcccggtaaccttgattggcatggccgccaactttggaagcgccttcacaccatttggcaatacccacaatatctttctgatgcaccaatttcaaattgacttgcgccagttcttcggctggtcaattccgttacttgccgttagctttttagtgttagtattgctaagccttttcttgcgtaatgtgcctgtcccgaatgtcccagctgaacacatccatatacaaatgcggccgaccatgtttgccattgccgttgcgtgtgtcgtcttcgctggggtcattggtcttgttcctgcttggttaggggctgttttggcgattgccttatccttagcactggaccctaaagatatgcgagacgttgattacgcggtggtcttaacgtttgctggctttttcattattgtcagcgtcgttggccagattccatgggtaatacacttccttgctggtttagaaaactcagaggaatctgtttatcttagtggtgttttcaccagtcaggttatttccaacgtcccgtctacagtgctgctggcacgctttacaggttatgtcgaggctttattttatggatcgaacatcggcggtgttgggacactcgttggttcaatggctaacttacttgtcttcaagcaatacatgatttatggtaaccggccccatactcgtttttttgtcggctttacgatttttaacttaattggtttgattttgttgggttgtgccggttactggttgacggttcgttaagaagcaatgacccacctcaaaaaagtcagccaattcgacatgcttcgttaaaaatcaggtcatgacagtagtcaaatattacataacaccggtaatgtatgcgttttcattgcttttctccggcaacgtgctagaattaggatttgctaaaaggaacagcgacattcgaaacgaaccaccgcgacaggctatttatggacctgtcgcactttgtttgtacatcagttgagctgtcctataatgcgtctaccagtgaagcaagctgtctatctgcctcctgatgtgatgatcaaattttaatcatcacatcaggaggtgttggcaccttgtctgctaaagatattggttgacgctcgctcttaggaggaagtatttatgaagcgcaggacgttgttttcgatcatcgtcatcacgctgaccgcaggattttttaccttattttacggtatgcatagtacttggacagatacccggtcagcgcaggccgttcaagccgctaccgaccaagtcaatgatttgttcaaggatcaatcgcatcaattaccttcagaccagctaaataagcaggctatagcagctgccgagaccaaattacaacaggctcgtcagaaggccaatgatgcagaccacgctgccgcacttgccagcgcacaagccgatgttgatgccgctaaacatatgctgattgttaaagatgctgtcgctcaaaatgcaacaaaactggatgagctaaaaacgttgtcagataagtcgcagcaagcattaactgagcttgccaagcagaagccaaccttcgtccagacctatcaaaaacgtgtggcacagttgtctgatcaagaagcggctgtggcaaaaattgccagtctttttagtgacactgatttcaagactcctaagccaaatctgagctcggcacaagtacaggctgcattggctgccgttgaaaaattggacaataaacaattcgccgaccaagttatgccgctaatcagtaccgctcaagatgccactgccggagaagacagtcgtgacaccgaaccgtcagcatcgtcagtactgcctagctccgccgatagtagtcagccagctgttgcagacagcagtagtcaggctagctcatctaccgctagcagcagtgaatcggagcaaagtcaggcatctagctcaacctcgacagcaacttcttcatctagccagaatccgtaattttttggatcactaaccgatgctcaggcacgcgttgcctgtcaaaaaaatgacgataccgcacacattcaaacttgtgcggatcgtcattttttattggccaccgctaaaagtcagtgccaattaatttgctgttttcgccttggccaattgcggcactaactgggtcaaatagtcgataaagctcaagtaatcagcaatgaccacattttcgttgggaccatgggcggcagaatgggcattgccaatcccgcatgaaataatcggtgcgtgattgatatcataaaagtacttcatcggtccgctgcctggagagttcagctcgacttgaacatcatcatccccataagtcgcacgggctagttgcaaagccgtctgaacacgtgggtcgtcaggatcggttctaaatggcggctcgcctagaaagtcagacaccatcacatcgtcataaccgccagccgtcaacgcttctttgactagccggacggtctctgccggtgtctgatctggcaccaagcgcagatcaagcttcgccagcgcggtgtgcggcaaaatggtcttgccaatgccgggaccctcatagccgctggataacccgttgatggtcatacttggccgattataaagggccgccttaatgtcatcagctggcaccgttgccgggcgggtaatgccgtagttcttagcaaacgctgcatagtcaaaggcggcgtcttgaattaacagcttttgagtagctgtcagcggcttgacgacatcaagaaaatgcggaatcgtaatctcatcctttgcatttttcaatgttgctagagcctgaaccaaccgccatgccggattttctgtgatcgcccctaaactggaatgaagatcaaaatctgccgttttaacgctcagctgaaacgcgacgccacctttcacgccaagcgagatttgaaacttgccttgctcatttcgaccgccagattcccataggcagaagtcagcggctaacagatcagcatattgcgctaacaggtagtctagatttggactgccttgttcttctgccccttcaaccaaaaactttatggtacaaggaagcccgccttgcgcttgcaggcgctgaagtgctgccaagcgtgccgccagttcgcctttatcgtcatttatcccccgagcgtacagatgggtgtcggtcattttcaactgaaagggatcactttgccataaggctagcggttcagctggttgaacatcgtaatgattgtagaacaagattgtgggggcatctgctgtctgcgccggaaaaaccgcgtacacagctgggttggtgcggtctgtgtgcaagatgcggcttgttgttgcgcccagcttggtaaactgggttcgtagaaattcggcggtttctggaatttcattttcctctgctaaagagacggaatggaattgtagataccgcgttagaaaatcctgcatgggtattgtcatttttcgacctgctttcttttgtcactatttgaagtaagcgtgccggtattccgccggttgtaacatgctgtagtgaagcccgccaaccttagtattgatcagccgactattagcactttggaaaacgggaatgtaccccgcaacatcaataacccgcgcattagcggccaattcttcctgataacgtgccttcgcgctttggccattggtgttatttactttagccatcaaggcagtgaactggctatcactgaacttagaaaagtttgaaatgttagtggctgtggcggtattgagatagtcggatgagtcttgaatcgttgagttccagctcatcagtacggcatcaaacttaccatcaagtgagcgttgaattcgggtcatttttggcaagctgctgacggtaacttttaactgcggtagaaccttggtgagctgactttggatgtactcgccgacttgtttatcggtgtcaacatctgaggtcagaatcgcaaaactgatgctgtcggtatgcaattctttcaaggctgctttgagataagccttggctttagttggtgaataattcagtggtgtatcagcatctgcggtgaaatctttgccagttgatggattcgtggctaagccttgcggaacaaaggctttagcaggtttggagccatcctgcaacactttagttgtcatggcttgacgatctaacgccgcagagacagctcgccgcaaattaacattgttgagctgtgggttcttggtattgaattgcagataattcatgttggccgccactgttttggtcaacgcaggatttttggcttctttttggattaagttgcccgacaacggtgcatcatcgagcttgcccgttgcaaaaaggttatcgatcgtgctggaatccttcaaaaccgtcacatgaactttagcgattttgacagcctttttggcaaaatattcgggatctttcacatagtcccagctatcactcgtggtattgaagtttttaattttatatgcgccattggtcacgattttatccgcgctcgttccgaattgcttgccataccgtttcacagcggcttcattagtcggataatagccagtcatctgactagcaaaatagggggttggctggctgagctgaattttgagtacatatttgcttggtgccgaaacacctaatgtatcaggggatttcttgccagcaacaatgtcatgatagttagcaatcgcatcgtattgatatgcaaattcggttttcgtcttaggatcaacgatgcgcttcaaggagtaaacaaaatctttggctgttaccggggtaccatcactccacttcacatctttgcgcagcgtcaacgtatatgttttcccgccatcagttggtttgacaacctttgtcgccatcgccggaatgatcttcccgtccttatcatggtcgtaaagcggcgtcataatttgttccaaaataccgccgctggttgcatcaacggcatgcgccggatcaagtgaactggcctctgtgctgacggcaacgtttagcgtacgctgggtcgttgcagccttggtttgctgtccgcatgcagcaagtagtgcggtgatcccgaataagcctaaacccaagaaaacatgctttttcatttttgtgcacctcgtttggttgatttgtgtcgcgtgctgccatcaagcatgttttgcttgatggactagcttccataacgcgctcgccagcccagaaacctgcgtgtaaggaccttggtcgcaatggccaaagtacgaccatcacacccaaggccacttacactccggtttctaaccgggctggatcgcgctcacaaaaaaagccgtccataacaaacatcttgttaaggacggtttcccgcggtgccaccttagtttgatcaaagagactgcgcctgtgtgatggtagcatcttgcagtgtttgatcacgcttagcccggggccaacaccccggcgacaactgacgtatgtcaacacgtttccccgtactcgaaaaactttcgggggaaccctcagtggtccatttactgacctgcgttcggccggactcgcagcatcgccggctctctgtgcgtgcacaatcagcttgatctccacttcaaaggtttgcatgaacggttatttgattgactcaaacactaaccgaatacctgcatggttgtcaagcaccccacaattaaataacacaaaatgcttcgcgaggcttataaaataacggatttccatttcctcaaaaagtgtagtcatgctgacccagcaaattttggcatcaagagcattcagtttggattatcaggaaaaaaactaaacagcatgaaaaaaggtgcaagttcattctcatttttgaatgaacttgcacctttttagtaaaccccttatattacaaatacattaatgtgtaacaaaaagaagttgtttcgtgacctgtttgcaatggtcttgttaagtccggcccgtaccattaggatattggaggtgccatcaatgaagcgaaaacatattttccaaatcttgatcgtaaccctgcttgcaggttacttaaccgttttttacgggatgcggaatacgatcgatacctcatttgaacaacacgccgtccaagcggcaacgcaacaaatcagccaactatactcgtcatccaagcgaactttccctgcgaaacacttatcacgatccatggtgaccgcagctcaggccaaggtcaaccaattagttcataacgtggaaaatcgcgatcaaaaaaaaattgtcgccaaggacaaacgggatgctgacgctgccagtaacatgctaacgattcaagaggcaactaacgcccagagtagtaatctggcgcagatcgaatcggaaggtacccgagccagtgcagcctataaggccattgtcgcaatcaaaccggcatttgcagctgactatcagcaagctgtcacacaactttacaagaaatctttagcgattgcgcaggtcaaaaaactttataacgaccagaatttacagcacccaaaggccgatctgagcagcagtaacattgacctagccatcaacgccattgaaaatgtcgaaaatcaggactttgccaaaaacgtgttgccattggtccaagtagcgaagaaatcacaagctaacaatgatacgaccgtggcaatggaatcgacagacacatcttcaaccaagcaaaccgcaactactggtcggcaaaatcagcaagacactggtgaaccagctagcggcgtgtctgggaatcacgcgacaactgcaggtcaagcttctgatcaaacaagtcaaccgagccagaaagctccgagtcaaccgactacttcaccgagtgggacaagttcaagcaccgacaataacgctggtgcaagtgcttcctcgtcaatatcagcttcagccaacaaagcagagcccatgacggccgttttgagcggcggtttgtataaaacctatgacgatgcagttgcatccatcaaaatccaaggcaaagccgttgatgacatgacgatcaggtctgtcacaatgagcgacggttcctttcagtggacttggggaccaaacggcgacagtggtagcagtagttcaaaaccaagttcctctgcgccatcttcttccaatcccacagggcaagatgcaaacaaaaacagtcaaccgcagcattagacctttgctactttcgaaaatcgctgataatggcctcttctcccaccatcatcggcgtttcgctacgttatcatatgattcaaacaacgtttgagtctcacaaaagacccgcatcagttcgacagctacgtcgaattgatgcgggtctttgggttttctactagttgatctgctgaatctgttcacgttcagcagttgcccggacaggatccacaagtgcctgccgatgcaagccattgcgcgctcgcagagcatagagaatcgtcacggtatcgacaacttcttgcagcattgcgccaataattgttggaatgacaccgaagctggcgattaacatcaaacctgtacaaatcgcaatgccgatgaggaccgcttgcttggcaatgaccatggtttccttagcaattaaagtggccgcagcaactttcgccaaatcgtcgcgcagaaccacggcatcagccgattcgcttgccgcggttgccccatgtgcacccattgcaatgccgacatcagcaatcgccaatgaaggtgcatcattgacaccatcaccaaccatcacaactggccggccatccttagggacgttatccaaaacttcaatcttctgttgtggcaattgttccgcatagacttggtcaatgccgacctgtgccgccactttatcagcgattgactgctggtcgccagaaatcataatcagcttagcatcatttaattcgtgcagtttcgtcatcgtttcttttgcttctggacgaatctgatcggaaaatgtgatcgcacctgcgtactggccatcaacattcacatatacagcggtcgtatcaaccgtagccttcgtcccagcaaactcggctttaccgaccttgactttgcggccatccaccgtggcattaacgccaaagctagtggtttccgacacatctgtcgctggcagccgatcagctgtcggcacagcatctgtcagtgaacgcgccaaaatatgagttgattgaccttccgcacttgcggctagcttcaaaagctgatcctgtgagaaaccggcttgtggcaaaatcgtcgcaacttttaaaataccgcgtgtcacggtgccggttttatcaaaggcaaaggttttagcatcacttaacttttctagcgtagtccctgacttgacaatgataccgttgcggctattacgactcatgccggagaccatcgcaattggcgcggccagaatcagcggacaaggcgaggccacaaccaatacctgtgcaaaacgaactgggtcgccagagaagaaccagccaagacccgcaatcacataagcaatcaacgtaaacggtaccgcataacgatcagccatccgaacaaaatgtgctggccgcgcttcggattccttaaccagtttaataatcccttgatactgactatcttcagcccgttgcgtgaccttaacagttagggcagcgtcaccattgacggtcccagacataatgtcactacctgcgtttttggcaaccggtttagattcacccgtcaaactggcttcatccaccaaactctcacctgccaaaaccgtaccatcaactggcacgacttcctgcggcttaaccaaaatcgtttcgccaacttggacggcctcaacgtcaacatcttcaacgtgtccatcaaccatacgatgcgcggttgtcggtgcattttcgagtaattgctttaattcactgcttgcttttgttgctgcgtagctttcaagcgcatcgccaccagtcagcatcaataacacgatcatcgcagcccaatactggccaaccgccaaggtggcaacaaccgccgtaatggcaagcaagtcaacgccgaagttaccagaacgaattgtcttcaccatgccccagaacataattaaagcaatgattgaccccatcaccgtgatcagcccttgcgcgatcaatggttgctttaaaccgaaagcaaagactagcgcaatggcacttacagcaagcaccatcattaattgccagttctttttcatcactgccactccctttttctaagtaccccaattataaccattacaatctgaaagcacaacctttttttagaacgaatataatctgtcccacttagatgctcgacattcatggtttctattaattgagccatggctaaactcttctaccgaaaatcaactctattgtccatcatccccaaccagtacgcttaaaccggcaatgattgaacccgttaattttatggcttccctaatattcacttcatattatacgcttctcatatgataaggctcacataacttgcttttttaacaaaataaaagaccgcaccattaaaatcggtacggtctctcgtatataaatgaagctaggcaaataattcgtagatcaatcaatgttgatctgatgattgcccttttggtcgcttgtcatttttggcagatcaatcgtcaggacaccatcattgaccttggcgctgatctgaccttcattgacatttggcagccgataactacgactcatgcggccatagctacgttctgacattaacatgttaccgtcgttgtcagcatgatcagcctgctcctcatgtttaacggcaatgctgagcacatcacgatcgtaactcagactgatattttgcttctcaatgccaggcacatcaactttcacaacatacgcctgatcgttttcctgaatatcagtctttagaacccgactgcgatcaacatttgctggtgtcaagctgtcaaaaagatgacgacccaaatcgttaaagaaaggatcgctcagccaatcattacgacgcatcaaatcattagccatattcgaatacttcctttcatatcgaaggcatttcatgtcttccctacaacacctttagtataccacaaaaattagcactcgcaaacgtcgagtgctaattttgtggtcctattcaatgactggttgatgcaaaaagtgacttaatagcccagagctaccttagcaaattttgccgcccagttttgtcatgtcatcccgacgttgtgcatcattttgtggtaaggcggcgtccttattcaaggtcacagccccatcaagaatgccgctgtcatcacgcagagccaacgatgcgtttttgaaatcaagtgtcagaccactaccgaaataatccgtttctgggtcacccgttgtcagtttgaaaccagcttcgttgtccagtggcagcgcataatcttgatcatcctcatcggcaaccactaactgatatttatttccaatggcacaagaaccgccaagtttggaatatttgcttgagccgtcatccagtgccaagaataaccgttgatcctgattgacatgatccttcaagtaagtgactgctgctggtttgattgagatttgcatccgaaccatcctctctattgagttgtgcacaacctttttaccttctttatcgtactcacatttccaaatgaagtcaaattcggagtttttcgcaacgaccaacaggttatccacacgtcttatccacatgttcataacttcatacgccaaatatagtattaagtattcgaattgacaccaaataggcgatttaaaaaattcaagcaaaaaatttttaaaaagaagtcatccacagtttttgatcgttcgatttcacaaacttcagctcacgcatcccgttccagccgctgggaacaaacgttttgtcacaagttaaaaaagtttatccacaggttatccccaagtcagtgaataacttagtcacaccccagaatcttagttatgaacagtatccacagagttatccacaggtaaagcatcaattttaggtaaaagttacccactcttgacaaatctttttctggaacttttccacaggttggccccttgaattttcggataaaagctcaaaactgcagagaaaccgcttgccactaacttcgcaagtgcatcaaaaaatcctcgatccagaaacgaacattttctgactcgaggattatcgatttgtgtgatttagttcttaaggtcgcttgtcgtttgcgacagcttcacagagactgtctgctgttctccggcacgatacaaagttaatttaatcgtgtcgccaaccttgtgtttgtatagctgtgtatgcaaggctgctgtgtttgaggtacttaccccatcaagggccgtgatcacatcatactgcttcaaaccagcagatttagcactgctgccgctggtaaagccagcaaccacaacaccatccgtcacactagcaggcaacttcagaaccgatttctgctgtgttgcagaaacagtggataagtcacgaacttcgatgccaagcgctggtcgaaccactttcccgttagcaacgagttgattgatgattgaaacgacttcatcacttggaattgcgaagcccatgccttcaatggtggcattactgccagagttgccggataatttcatagagttaataccgacgacttgccctgaaagattaatcagcggaccaccggaattcccagaattaatcgctgcatccgtttgaataaccgttgcctgtccggttgtgttgccactatcatccgtgacatccactgttcgactcttcgcactgacaatcccttgcgtcacacttgttgcgtactgggaccccagcggtgaaccaattgctaagacagtctgtccagtcgcgatcttgctagaatctccgaaactggccacggtattgaccttgctaccatcgatggtcagcactgccaagtcagacgtcgagtccgtgccaacaagactggccgttagtttcgtaccatcgctcaaaatgacttccaacttatctgaaccactaacaacatggttattcgtcacgatataagctttgccatctttcttttgataaatgacacccgatccttcactggcctcttgaagactggacgaactgctttgcgaactactactgctttgactgtcttgtccaaaaataccttcgagaccgccaaatgtgtctagaccatcactgttgctctcggctttttgcatattcacaacggaaacgacagcgcctttaaccttcgcaaaggcttgttccgatgcactgctttcattaacagaaacgttggaaatcttggtcgtaccggctttccctgacgtatcggttacaccgagactttgactgtggttgattgccaaataggcagtcccgccgccaacaccgccacctatcaaggctgccacaacagcaacaatcgcaatctgcttccagccgctattcttaggcttttttggtgcccgctgtggctgttgctcgttttgtggtgtctcttgaaagttatgacttccattatccataacggaattcctcctttaaacgcgctcgtttgcccagaaactgactcataagacctagccgtttggctgaggccgctaatacattggtttttacctggactagttcgcgctctatgggcagttctaactcgccctgattacatttataattgtaaggggcgattttgacgaaattatgaacaacctcgggattttttaatacagtctcagacccgcggtatcgcgatattagttcgtggggttgcttattttttgcaccatcaataaaaaatgaaaggcagtgaatatgcgaccggatttttgggtcgggatattcactgccttgggtagcgtgtggtagcgttggatgacggaaaatgcttaagacgccaccgctgctgcggaaacacgctcgcagtcgcagaaacctccatgtaaggacctcaggtgcaatggccaaagcccagccatcacgcctgaggccacttacattccggtttctaagcgctcctgctcgcgctttgctttataccacaaacagcggatctgcaactgcaggatcggtgtcgtagatacgaaagtcgtgatcgacggctaggccttgttgagctaatagtgaagcgacggttaggtgtgcgagtggtttattattgttgtgcggagaaaggtgtcctaaataaatgcgcttggttcgcagcccgataacatccatcaaggcatcagcgccgtcctcattggaaagatggccttggtcgcctaaaatacgctgttttagtggccatggataaggccccgttcgtaacatctcaagatcatggttacattccatgacataggcatctgcatcacgaatggtacctgcaacacggtcagaaacataccctgtatccgttagaatcgtgaaggttttcccgtcatgatggaactgatagaactgcggcgccgcagcatcgtgtgaaacgccgaaactctcaacatccaaatcacctaatgtcaacgttgcgcccatgtcaaaaagccgcaattggtcttctggaattttgccaacacttttgggcagtgccgcaaaggtttttgcattcgcatacacactcagtttcggataacgtcgtgctaaaacaccgacaccacggacatgatcactgtgttcatgggtgatgaagacactatcgacatctgtcaggtcgcgcccgatgctttgcatcagcgtctcgatctttttgccggacaagccggcgtcgaccagcaccttatgacccggcgtttcaatataggttgcgttgcctgaactgctgctagcaaggacactgacacgcatcccaaaatcttcgcccacgatcaacatctcccatcttctaccatttaactgatgaacaaattgatcatccagtttttatttcattacattctaacactaattgtcattacgattcttcataaccgttcgggtaatggcattcacgcgtttaaccgtcacattgccggttgcacggtttttaacaccgatataccacgctggcacgtataccgtgctcccctttgcatctaacaagtaactataggccaatttagtagatacaatcgcggaattgttcggaatatcgttatctcgatacaacgtaatcaccgcatcctgttcactcattaaatttaagcggtcgcgcaaaacacttaactttgcaaggtaagtttggctataactgaccaaccgatcgtcaactacatgcaaggtcactgcagcccgccgatcatagatcaagccagccttggggtgctgagcaaagacaacacgttcatcactggaaagcgccggcgcatattcgtattcgctgccatggtaaatactgtctttcacaaatgtcgtcagttggcgtatttgctgactctttttcaaagtgatcggcgtgtctaagcttgcctgcaactcttggtaatcaccttcactgatgctgacctgttgcttcaccaacctgctgtgcgcagcacttaacgctgtgttcgcctgacttgcaagataatcgccttctggtgtttgcttgctcaaatgcggcagcttaatctggtcacgcgtaatgtcggtgatcgtggcggcatctccacttttggttgttgccaaatcgacctgctgcgcctgaaaaaagctaatgcctaagaaaatattcagaccgacaaacacgactagaaaaatccattcaatgcgtcgaaaatccacaagatcgcctccctcagcgtgcccgaagctgcgttgttacgctgttaacatgacttattgcgactgacttgaacctgatgtgctgacactcgcgcttgctgcatcattactcggtgtagccgtgctggcagctgtttgttcactagcagcattagcctgctgatctgtttggtgattgatccaactctgataatcgcggtattcgcctttcatctcaatataatacgtcggctgcaaatcgaccacttgttgatcattgctgctgcccgtccattgatagccaatcaaaatatccgtaatttgattggcgcgatagccagcggcttctaattgactcaggatcgtcgcagttgctggcaaggtctgggcagcttgatcggttgggatcgggacggtcaaattggtgtttgagaaattaatctcttcagatgtctgggtatagcgcaccgtaacatcccctttttgatagccattaaaaatcggaaagccctgaacaaaggtcttatagataacagcactgcgacttgcgtcatattgaaaataacgcatgctggccagattggtcatctgcaaatcactaagcccttcaaacgtcgcatggaagaaattagctaacccagtactaggaaaattggccgcataattttcaaactcgattgccccagtggatgaatcagctgtcatccgccgagttgatccggcggtgtataacgtactatcgccaatttctcgtgaatccacgttgctggcggttttcgatggcattaacagcgaaacatagtaattagcactctgttgatccatcagataggcatatggctgcaacttaattggacgggtgaagaaagcgacttcgttattgcccaagcgtctctcctcgaccggaaaggcccctgtagcttgtttagccaccgcatcgcgtaacttgttggttgtaacgttagccattttggcctcgtaaaccgttcttgtcgcgtcattgataaaaatcagtttattgcctgatccatctaaatcaaacaggatccggttaaaatgaaagtcagctgattttagattaggctgcttgttaaagaaccatcgttcaaaatgattaaaactcatcacgtcttggtaaactaattgcagactgccattttgagtcaaaaagttctcatagttattctgcgaaacttttccaatggttttgatctgttgcatatgccaactcgccatctcttgatggacacgcgagcccatactggcatttgcctgaaagagcatttgcttctggtcgccatgcgtgtagtacacgcgactaggaagataaaccgttgcttccatctttttaacattgggatcattttcagttgtgacctgcatgcttgaagtgctgcgccgttcctgacgcgatggattacgccaaattaaggatgtgaaaataaaactcaagatcaccatggcgatcaggctgattcttaagatccaattactaagcttcatcccaatcatcacctccgtctgtgatcggttcatacggcagtgagatatagaaggtgctgccgcggccttcttgcgaatcgacccaaattcggccatgcaaggcttcaacaacttccttcgagattgccaatcctaaaccggtaccgccttgctttcgtgatcgtgccttgtcgacccgatagaagcgatcgaagattttgcccagatcttgacgtggaatgccaagtccttgatcactaatcgataggatcacgtggtcatgcgtctggaacagccgcgccgtgatggtcccgccatccggactgtatttaatcgcgttgttcataatattatcaatcacttgcataaacttatcggtatcaatttcgacccataagtcctgatcagtaatctcgcgcttaatcgagtaccgtttcttttgaccatctggctgtggcagcggttgggccgttttggcttcacccgtgtgttcattatcggtttttaacatcatgtcaaaacgatcaagcacataattgaagaattcgttgagattaacggtttccaaattgaacttgctggtgccagaatcaagccgtgacaagctcaagagatcattaatcatccgaatcatccgatccgtttcttcttgggtcacgttgagaaaacgtggcgccagctttggatctttccacgcaccatcactcaaagcctcaatgtaactgcgaactgatgtgaggggcgtccgcaattcatgtgacacattggaaacaaattctttgcgatcacgatcaatcttttgttgttcggtgacatcgtgcaaaacagcgaccaaaccggaaataaacccggtttcccgctggatcagactaaaatcgacacgtagaatcaattcatgatccagttgctccgaaaagtccaacaacagttctgtttgatgttccagcagatcgcgcaacgtataatccttagcgatgttcaacagctttagaattgaaacaccgatgacatcttcattcttggtgttcaggaaattcagtgccgtctggttgatgatgataacattcccacgccgatcagtcgcgataacaccgtccgtcatgtgagccagcacactatccaaacgccgacgttccgcttcagacgcctcttgggcttcttcaacgcgaacactgaggttgttaacggcaactgccaactgacccagctcgtcttgtccataaatccgaacctgtccagaataatcgccgcgcgccatgcgaatcgcttgcttcttcatttcatcaattggacgagtaatagcccggctgatgacaatcgatagtaaagtgcccagtaagccagctactaaacttgagattaggaaaatgcccacgattttattgatgctatcgtaggcctgttccatagatgccgaaatggcaatggcgccgatcactgaattgttgtcgcctgtcgcattcggatttttaatcgggatcactttataataagttgaccccgttcgatcacggtattcataaccttcgtattgctggccagaatacaatgtgtttttaatgctggagttagctgatttttgccccacattggtttgcgcattaatatcactgtcgccgcgaatagtgcccttcgcatcaaccacttgtaaatccgccgagttggcaatatctgcctggctcaacgtgcttttaatatcatcattggcgccttctgtatcagtccgcaacaaatccgcggccagcttatcttgaatatagctgtccacgttcacactggtcttaaactgctcaatgttttgctgctcaagggtcttaacaaagtaagccccaattaactccaacgtcacgactagcaagagaataaagacgatcgcaattttgaagtggattgactgaaagaagcgaatctttttattcaacagtggtgctcctaattattcagcatcgggattccgcagatagtaaccgacaccgcgccgagtcaccagccattcagggtgagacgggttgtcttcgattttttcacgcagacggcggacggtcacatcgacggtgcggacatcgccgaagtagtcgtagccccaaacggtttgcagtagatgctcgcgagtcataacctgcccgaggtgtcgggcaaggtagtgcagcagctcaaattcacggtgggttaattcgatgttttcaccgcgtttagagactgtataggcatcgggatgaatcgttagatctccgacttctaattccttgtttgcttcgtcttcttcattgctggctgcgttggatgatgcggttcggcgcaagttagctttgacacgtgccaccagttcacgattggaaaatggtttggtgacgtaatcgtcagcaccgagttccagcccgagcactttatcaatttctgagtccttagctgtcagcataataattggggtgtcatgttctttacgaatttgtcgggcgacttcaagcccatcaatttttggtaacatcagatcaagtaaaattaagtcgggtgactctgcttcgacttttttcaaggcttcttcgccatcataagcggttacgacatcgtaaccttctttatccaaattaaacttgacgatatcagagataggcttctcatcgtcaacgaccaggatttttttcgccatcattggccctccttggtttaagatacactactatagtataacggttttagggaaagagcgcgaggggcccagcttgaaaccgaagcataagcggccttaagcctaaatggcaggacttggttcatttaagcttgaggttcttatatgcaggtttctgggaccgcgagcgcattttctacaagcacgttaggtcgcacttcgatagattccggcttgcattaaatgctgctgcaagcttgaaagggtcagttaataaacacttcgccattcacctcgtcttcacactaaacgcgcatcgctattccggtgcttgccgacatttaatcacccaattatgaattttggaggttgctaatatgttcttttatcatgatcagctcaggctttactatcaacggtgcggttcgggaccagtgatcgtgttgttgcatgggaatggtgaggaccatacgatttttgctaacctaattgagcaattggcaccgctgtatacggtgattgcgatggatagtcgcgatcatggtcagagttcgcggacgggtcgcttgagttatgatgcaatgacggcagatttagcggccctgatcactggcttggagcttgagcagccgattttacttggcttttctgatggcgcgattgtggcattgcagttggcgattcgtcaaccccagttagccggcgctttaattcttgctggggcgaatctgaccccgcaaggcttacgctggtattcgcgagttgcttttcgggttgctgctggttaccatccatcacctaaaatggcgatgatgctccatgaaccgcaaatcacaccggccatgttgcatcgggtagccataccaacattggtccttgcaggcagtcgtgacttgattgcacgaaaagaaacgctcaccattgcgactaatattcaaaacgccgagctgcatattcttcccggtgaaaatcacaattcgtacatcaaagacaacgcgaaactctggcaattgattcggccttttcttgctggtttaaacagaacagactaaagtttagtctgtattttttttgcatatttaacattttccttgcatattcatataaatgagtatatattcaatccataatcacaaatgaggagtgaaacatatgcggggaatcaaacattgggccatggccttcattgcgctggtggctatgctcgtcggcttcgctgcaaatcagccggtaccaacggcggcagcaagcgaggatctggcggcaattcaaaaacgtggttacttggttgttggtctgtcagccgattacgcaccacttgagttccatgccaccctcaatggggccgataccattgttggtgcagatatctccatgtcaaaacagatcgccaaagacatgggcgtgaaactgcagatcaaggaaatgaacttcaccgccttaattggtgccttgaaaaccggcaaaattgatttgatcgtctccggtatgtcaaaaacccctgaacgtgaaaaagaagtcaatttttcaacgccttacctatatgagacacaggttatggtgattcggaaggctgataaagccaagtataaatcgatcgctgatttttccggcaaaaaggtcggggctcaaaagcaaacgacgcaggagcagcttgctaaaacgcaactcccaggtgccaaaatttcaagtctcgacaaggccaatgatgtcattgctcaagtctcctataacaagctggatggtgccgttttagccagcaccatcgctgattcttatgtggcgcggacaccaagtttaatggtactcaatccgcattttgctacccccaaagcaccaacggccattgccgtcagcaaacaaaattcagccctgctcgctcaggtcaacaagacaatcagtaaggtcaaaggcgccaaatacaagacctatctgcaagccgcttataaactacaggatcaaaaccaaagtttctgggctaaatatggcaactacttccttcgcggcgcactctacactctgatctttgcggttctaactgttttcttcgggactgtgattggcacgctgctcgccttgatgaaactaagccacagttggtttgccaaggcaatcgcgaacgtctacatcgaattcattcgcggtaccccattactggtgcaggctttcatcgtcttcttcggaacgcaaattctcggtctcgatcttagcgcattcgttgccggtgccatcgccatggccatcaactcaggtgcctatgttgccgaaatcattcgtggtgggatcaactccgtcccgatcggtcaaaccgaggccgctcgttcactcggactccatcaaggtcaggccatgcgttatgtcatcctgccgcaagccaccaagaatatctggccagcgttgggtaatgaattcgtcaccgatatcaaggaaagttccgtcttgtccgtgatcggtgccactgaattgatgtttgaaggaaccgtcgttcaaggtgcttcattcaaaccattcttaccgctagttgttgtggcaattctctacttcatcatgaccttcaccctttcacgcctgctgcgactgattgaaaaacgctttaattaagatcaaagtaacgctcaaatagcacctcaaaactaaggaggatttttaactcatgacagaaaaaatcgtactggcatattcaggcggcttggacacttcggttgccatcccgtggttaaaagacaaaggctatgaagtgattgcggtggtattaaatgtcggccagccaaacgccgactttgacgccattcagcaaaaagcactgaacgtcggtgcactcgattcgattgtggttgacgcccaagatgaatttgccgatcactatgttgccccggtcattaaagctaatgccttgtacgaaggcgactatccgctggtttccgccttatctcggccattgatcattgaacatctggtgaaaattgcccacgcgcaaaatgccacagcgattgcccatggttcaaccggtaaaggcaatgaccaagttcgctttgaagccgcgatccacgccttggacccggaaatgaaaatcgaagccccgatccgtgattttcactggtcccgtgaggaagaaattgattacgccaaggagcataacgtcccggtaccaattggtaaaaaatctccttattccattgatgccaacctctggggccgtgcaaatgaagccggcattcttgaaaatccttggaatcaggcaccagatgatgcttggggtatgaccgtttccccggaggccgctcccgatgatccaacttttattgatctcaccttcaagcaaggcgttccggtggcgttaaatgatgaacccatggcgctggcaacgatgatcaaggagctaaacaagctggctggcgacaatggcattggccggattgataaaatcgaaaatcggctagttggcatcaagtcgcgtgaagtctatgaagcaccagccgctgctgtcattatggcagcccaccacgatctagaaaacctgacgcttgaacgtgacgttcagcattttaaaccaacgatcgaagataaaatcaccaacatgatctatgaagcgcagtggatctcaccgttgtttgatgccttgatggcgttcattgacaagactcaggctgtcgttaatggcacagtgaaaatgaagctttacaaaggcaacgccacagccgttgctcgcaaatccgcccacaactcgctttacgatgaagatctcgcgacttacacaagcgctgattccttcgatcaagaagcagcagctggctttatcaaactctggaccttgccgacaaccgttttcgagcaagtcaaccatgtgcactccgaggaaaaacaacatgactgataagttatggggcggtcggtttactgaaaaagcggcacactgggttgatgcttttggagcctccatcggttttgatcagcaaatggcccaagaagatttggaggggtcgcttgcacatgtcaagatgctgggcaaaaccggcatcatcccccaagccgatgccgacacgatcacggcgggtttgcagcatctgcagaaggaattggctgctggcaaactgcacttcacggttgaaaatgaggatatccatcttaatatggaagccctgttgaccgctgaaatcggccccgttgctggcaaactgcacactgcccgctcgcgcaatgatcaagtcgcaaccgatctgcacctctggttgaaacatcgcctaccaacaatcaaagaagctttgaccaacctgcaaaccgtgttggttggtcaagccaaggtccacgcagcaacaatcatgcccggttatacccatatgcaacacgcccagccgatcacttatggtcattatttgttggcgtatttcgaaatgttccagcgcgattgggaacgtttcgactttacccaaaagcacaccgacattttgccattaggggcagccgccctcgctgggacgaccttcccgattgaccggacgctggttgctcaagagctgggatttgaccaaatttatcacaacagcctcgatgctgtttcagaccgcgactttgcgcttgagtttctcagcaatagtgccattttgatgcagcacttgagtcgcatggcagaagagctcattctttggtccacttacgagtttaattacattgaactcggcgatgatttttcaaccggtagctcaattatgccgcaaaaaaagaatcctgattttgcggaacttattcgtggcaaaactggccgtgtttatggcgccttaatgggcttgttgacaacgatgaaggcaatcccgttggcttacaacaaagatatgcaagaagataaagaacccattttcgatgcttataacactgttcttggctctttgcacattttcactggcatgttaagcgacctgaccgttcacgaaaaacggatggcagaggcaaccacgcatgacttcagcaatgcaacggagttagcggattacctcgcgacaaagggtgtgccattccggcaggcacatgccattgttggtgagttggtactcaaggggatcaaaaccaacactgccttgcaggaaatgccgttaagcgagttgcaagcagccgcaccgcaaattcagcaggatgtttacgctgaattaacgtcaaaggccgccgtagatcgacggacttcgttaggtggtactgcggttagcaatgtgttgaaagaagttgctcgcgatgaggaaatgattgcttctcactagcggtacgtgatcaccttggcattcacgaaataattgaggttggaatatcgtttacaggcactaaaagacgactggtttccctactacgtggagaaatcagtcgtctttagttttttgataaatagctcgtaggaagtcaaagatcccagtgccaaggcggcgcaatcgtaggccagatggggctcagttgcgcaaacaacacagcgaccgggctttgtcgctgatgttgttaggcgacttcgagaccggtctttgggctcgaagtgccatcaccgctctagctatgcgtcgccaccccatctggccggagattgcggagtttggcacggcaaagaatctttagcctaacctattaagcattcgttttttcaagaacaaatgttgaccacgggcgaataagatccagaaagcctagatcatcagcactgacttggccaattttattgcgctgaccgtcatcggcaaatggcgttagcacaatttgaagctcgcctttgtaacggccataagcatcattcacaacaaggatatcgccgcgttcaaaggactggtgattgtcatgcggtgcaatgctttccttgccatacttcacccgcggttgtgtatcgcgcagtaagtaggctgaggcatcgccacggtagagatgcggcgcttcaaaggcaatcttcgcctcaattggcaacatccccggcagcatatcagcatgcaaaataggatatgctgccacgaagttagcagccacctgttgcaactcagcttcactagcaaaggcattgccgatgatgacatcatcaatcaaaccggtcatgactaagtggctggtttggctggcgatgcttcgatggcgatcgctttccattgttggcaggccatcattgaccgcccatggaccgatcttgccggttggcgaagagacaaacgccgctgtgtgcagcccataatcacgatattgctgagagtactcagcaaaaatctgatcacttaatcccgtaaaggcttgtggataaaagttatgacagccgagcaggttgtcacggtccggttcataggccatgatactagccaaataattggttccgcgactcatattcagctcaatcttcagcccgtatggattacgcgtcatgcgcgcttcttcagcaccggtgaaaccttcatctagtcgcagtccccaaacattgagctttttgaaaaagctcagatcgtcatagctgatctttagctctttgaacaaggccggattgatgtcgacaatcgtttggaagcccagtcgattagcataatcaatggtttggctgaaaacagcgaacagatcctctccgtcatccccatacatctgcaataacgaggtgaagatgcgggtataaccatattgatgcgccatttcgagataggccttgttctgatcaaaactgctttgatccggatagagcgatattcctagtcgtttcattgaaaatcctttctaagccgtgtattgtgccgccatctggcgagacatctttttgaaccggtgcttacgctgccagttgagtaaaaagccggctgtacgattgttagctttgcctttcgcggttttgccttcaatcgtttccgtgtaatgtaaagccgttttgttgtcaccagcgtcgcttagctgatagtcaaccgtatagtgatcacgatcagtatccagttcgtaagcataacgttggttggcaatggcatgggttatcgtgagtgtcccagtcatgccattagcccatttcttcttgtaagagaaaccattgagactgccagttaacacctcgcggccggtatgggccttgatgtcttcctgcgcggatcgaatgagttggccatacataaatgctgctggcaccttaaatgtcatttggatttccaagtgaaagccacctttctaaaaacgttgttcagcccaaaaccagcgtgatgggatgttagtcgagttcagtcggtttgatcttattggctgccttaacaaatggcacatagatcaggaaaccgatcaccatgttgattaattgtagcacggcagcacgccagtccatcgttgcaactaaggcattcaggaacggtggcattgaccaaacaatctgagccttaatcggtgaaaccaaaccgttaactacggcaccataggcaattgaaaccatcactaccggtgccaaaacaaacggaatgaagtaaatcggatcaagcacaattggcatcccgaacatgactggttcgttgacgttgaagaagcctggtgcaatcgataatttagcaaccgcccgctgatcatcacgttttgagaagatcagaatcgcaatcagaagtagtagagttgaaccagccccgccgatccaagcatacagatcaaaggagttccgggtccacaaatatggtaaggcttcaccttttgaaaaggcgttagtgttagcaatctgagccgtcagccagattccatcaaggattggtgccaagacgttcgtaccgtgaattccgaagaaccagaaaacctgaaccaagatcgtcattatcaacacggatccgtaaccttgactcagattcaacagcggttcctgcaagactttagcaatgaattcaattactgtagtgccatattgagtgaagatatagttgataataccgacagcatacatagcaacagcagcagggacaatcccagtaaacgcattagcaactgctggcggtacggaatcaggcattttgatggtgatgtgtttcttcatcagccagatatagatggtagcagcaatggcccccatcagcatcaccgtgaagaaaccatatgcgccaaagaacttaccaaaattgaagaagccccacatgctgacatccttgccggtaactgctgccccagcatcggtcagtgacttgatcgctgctttacccaagccggttttaaccgtcatggtgaagttttgcggcaagctcatgatgaaggtaccaagcgtcacgatccccgccgtgactggttcgaccttatactgaactgccagttggtacccaaaagtgaacgagaagatcaggcctaaaattgccagtgtccctgtccagacaacggcgttaataccgatcagccattgcatggaattaacaaagcccgtccagccaaactggttcgggatatcacgaatcaaagcgttcagcaccgtcgatacggcaccagccatcatggccggcatgatggcaataaaagcatcacgcaacgcaaccagccaacgaattgagccaattctggcagcgattgggacaacatgtttattgagccaattaataagtccgttcatttttataacactcctttttaagtgggcgcgagcaggcacggcgtgaaatcaagacgtagctagctttgacggtcatgatctgcttttgatcattgtttttaagctgacagcgtcagattccggccactgcaaacgcgcgagctattaatttgaactgaggtccccgcctcattggtccaaatcaatgttggtcgtgtggtaatacagtgtgagacctggataaacaaaataagttcgagaaaagttgaagactttgccgctggctagatagttaatcccatccagacataaaagatcgccttttccggatgtggtcatcaggtcagcatattcagccggcagcggccgagactgaatataattttcggttgtgcttccaaccatgtcataggtgttgcgcaaataggtaaagattgaccccgcagcaatttctgccgagagatgcggcacaatgatttgtggaaagtatgattcttccaagtcgtacaactgcccttttaaatagcgcagacgcacaacctgataaaccggatcgccaactgctacgttgccgcagcgggccaatgccgcagttgctggtatcaaagcaaatttgacgactttcgatttaagcggaccgcctttgaccatcgcggtttgatcaaacccgattgacatattcaagacggcgcttgattgctccgaatgatcaatgacgtagtagccactgccctgcactctgcgcacgagtccatgggcaaaaatgacatccagcgccttacgaatagtgttgcggctggcttgatagcgattcatcagcacttgctcggtcggcaacttcactggatacttaccagccagaatatcttgaatcaattgctctgcaatatcgtgatacatttatgaccccctccaaaggtgtggttttgaaaacgcttgtaaaatttgtacctacgaattataatagcacaagaaacagaaaacgattacatttttttaaaaaggagccgaaaaaaatgacagagaaaaagattatgttggtctgcgccgctggtatgtcaacaagtatgctggttgcacgcatgcaaaaagccgccgaaaaagatggtattgaggtcaatatttttgcaaccgccgcttccgatgcagacaacaaattagctgaggaaaaaccagatgttctgatgttaggacctcaagtccgctatcttgaaggtcaattcaaaaaggatctcgatattccggttgatgtgattaacatgcaggattacggcttgatgaacggcgaaaaagtcctcaaggcgtccttgaaggcaattgcagatggtaaacaaggagaagaagcataatgagtgaagaagatcagaacctcgaaactgtcatgggcttgatcatgaatggtggcaacgccaagagttctgcctttgaagctattcacgcagccaaagcaggcgattttgaaaaggccgacgaaaagcttaaagagtccgaccactttctgactgaagcccacaacgttcaaacaggcatgttaactgctgaagcccaaggcgatcatgctaatgtgaccttgttaatggttcatagtcaggatcatctgatgaatgccatcaccttccgcgatttagctggtgaaatggttgatttgtacaaacaattaagcgagaaagaagcctaggcaaacaaataagccttcgccacgcgatgacgcatgaaggcttatttgcagtggccattgtgaataaacggctgttatgaaatcccaaataatcgcaccaaaaaggcgactcagcaaatgagccgcctttttaatactatatgttatttttgctggcgacctgcctgccattcttcccgcagaatgccatacttaacagagtcccagtaacgatcctgataataacgaacttgtcggacacgcgcttcctcctgcatgccaactgctttagccaaaccgatcatccgatcattgcctgaccaggtggtgatacctaaatgcggcaagttgacgagtccgaagatgcgatcaatccactgatccagcgcatcttgcccataaccttttccccaatcagccgagtcatagataacgatgccaagatccagccaccgctgcagatcgccatcttcataatgggcagagacgaccccaatcaaaacgccgtttgaccaaataccgttgacaaatggattggcaacccattgaaagccagtttgattggcctgattttcctgcagttcttgtagtgtcggtacttcttggttaaaatacggtccgtcccactgatgccattcagcctttggatcagaaaaagccaccttccacagtgtttctagatcttcagattgaaaatgttttagcgtcactgtcatgcgttcaccgctcctttgatgtttgttaacaacataccacaattattgcccaggaaataatgcaatcgtcaactatgttaatgtcagtatagcggtaaacgattcgagttaatcttagataaggagtgaatctcatagtggcagattatattaaagatatccggacaaaggttggtcatgcgcccttgattatggctggcgtgattggcatcctgaccgatcaggctgggcgcgttctactccaacaacgcagcgattttaccggtgaatggggcttgattagcgggacgatcgaatacggcgaaacccctgcccagacgatggtgcgtgaattcaaagaagaaaccaatctggaggttgaagttgtccggttgcttggcgttaatggcaatctcaccctcacctatccaaatggcgatgttgcccaatggctgtgcccggtgtttcttgtgaaacaattaagtggtgtgttaaatagtgacaacagtgagactgaagccttaaaattttggaatccagcagccgctcctgacctgtttaatcaacaacatcgggaagtcttggcgcactttatcgcaaatgaaacggggtattttgattgaatcgattgatcattctgcgtggcaattcaggcagtggtaaaaccaccaccgcaaccgccttgcgtacccaactggccaatacgctgctagtatctcaagacgtcgtgcgccgtgacatgctcgccgaaaaagacaaaccgggcaatcccacaattgaactaattgaaacgattgctcgctttggattgcagcatcagcgaactgtcatccttgaggggattctgtcggcagcacgctatggcgacatgttgaaaacactcattgcagaagctgatcaaagtctggtttactactatgacctctcgtttgatgagactttgcgccgccatgcccatcgcgcaaaagccaaggaattcggagccgacgtcatgcgtgactggtatttgccccatgatcgtttaaatgtgccgactgagcagctcatttctgccgattggtcgcaaaccatggtcatcaaccacatcttgaccgatctggctggattgaacaatacagaatctgttaaacccattcactgacaaaagacagcaactcgcgggctcttttccaaactgatttgatagcgtcttcttgtccttaacggcgggcaaaatcagcattggcataatcgggcaaaatattattgttttcatgggtttcggactagaatgggttcgtaaaggttagttcattattagtaatggctataacgcgctcgcagtcgcagaagcctgcacatacggaccttgaaccagaatggccaagttcgagccattctggttcaagcccacttatgctccggcttttaagcgctcctgctcacgctcggttcataacgcgctcgtcagcacagcagcttgcatgtaaggaccctgctcgcaatggtcaaagtacgaccatcacggacagacccacttacactccggttgctaaccgtgctgactcacgctcactaaaaggagtgatttttgatgacaagttatccacgccgtgacccggttactgaccggctgctcaccccggaaaattctgctttgattctgattgactaccaaccgacacaaattgaatccatcggttccatgaaccatcacgctttaatccaaaatgttgtgatgacggccaagttggctaaaacgtacaatgtgccaattgttctctctactgttaacgttaaaagcggacgcaataaagacaccatccccgatttaaagaaagccctcggcgatataccaagtattgatcgctcttcgattaatgcttggcaagataaagagtttgtcgaagcagtcaaggcaactggccgtaagaacttggttatcgcggccttatggacagaagcctgcctaaccttcccaacaattgatgctttggctgaaggctatcatgtttatcctgtcgtggatgctgttggcggcacctcacaaattgctcatgaaactgctttacgccgcgttgaacaagcaggtgcacaattgaccacaaatgcccaactggcttgcgaatggcagcgcgactggaaccgaaccgacactgtaccggattttgttaaactgctgctgggtgcaggcgactttatcaatttaggcgactagctttttaacaatatgacatgaacggggctgattaaagcagccccgtttcgtttcttatcgcttatgatgtgtacctgcccatgacatcgcatgatgccatgaacaggtaccttattttattggtgagcgtgagccagagcgattagtcaccgaagcgtaagcggcctctggcgtgatggccggtctttggccattgcgactgaggtccttacgcgcaggtgactgctctggcgaacgcgttatggttagggggattcaacatgcaacgttctgaaacggcaccaaaacgttggtggctactggtcgcgctgggcttttttgccttcatgaccaatctcgacggttcaattgtgaatattgccgtgccaattatggccaaggatctcaaagtccccaccagtcagatggaatggaccgtctcgctgtatttaatcgttttaagtgcgctgctattgccctttggtaaacttggcgaccgcatcggtaagcagcggatttttaaatggggcaccggtacatttgtcttaggttccttgatggctgggattaatctcggctttaattttttgatgttagcccggatgatccaggcacttggcggggcgatgactttggcgaatacgtacgggatcgtcacctcgactttcgcacttgctgaacgtggccgggcaatgggggttgtgagtaccttcgtcgcattgggtggtgtcgctggtccaagtctaggcggtttgattttggcccatttcagttggccaatgatttttctcatcaacgttcctattggtttaatcgcactgggtgtctccttgtggtccatgaacaatggcgtcccgcaacgcggtgcttatgatggttggggcatgattttacaggcaacggcaatcgctagcggtttctggggactaaatctttctcagcaaagcggttttgacgatccagttgtcctcagcacccttgcattggcagtcgttgctctcatcgcctttatcgtctttgagcaacggcaacaagcaccattgcttcctttgcgtattttccgtgtccgtattttcacactcggtgtggtcactgtcttcttcatctttatggtgcagtttttcagcacagtgctgatgccgttctaccttgaagatgctcgtggcctgacaccaggtacggctggcacgctattatcgctttatccactgatgatggtcttcttcgccccgtttggcggttggctggccgataaatggaacgtcccagcagttgctttgctcggcagcatttttatcgctgtcggcagtcttatcggtgccgcgttgaaattaaacgcaccgttgaccatttacatcatcagtacactccttgtcggcatcggcagcggtctttttcaatctccaattggcgatgtggtcatgtcagttgttccgaaaaatcagcttggcatcgctggcagtttcaatgcgctcgcacgcaatcttgggatggtcagcggcacggcggttgcgacaacagtgctctttggcacgatgagtcaacttgctggcagccgcgtaacgaactatccaacagcacatcccgaattctttatcagcggtttacaagttgccatgattgtcgctgctgtgctcgctattctcggagccatcgccatcggcctgacaatcaaaccgtggcaggcacacgaaaaaaactagtgtcagttttcatgacagttcatccgtcagaacacctcattttccaatgaaagcagacgattgtttcgccggtaaatcaacgttcgtgcaacaagtccacttttcccttcggctcaaaaagtgctagcataaaagtattgtgtccgcttgcacagcgtcagcagacgtgcttaggaagcataacctgaatggccgagttttgactatttatgactggcatgcttacatgtaggttgctgcgactgtgggcgtattctaatgacggaggaaaacagccatgaaaaagaaccacacctcgacagcctggttgacttggggcatcatgctggtcggtgccaatctgcggctgcccatcacgatgatcccaccgttgctgccgacaattaagcaaacactcggcctacctgcatccatggcaggtatgctgacaaccattccattgctcatgttcgcgctggcctcaccgttaatcgccaaaatgggtaatcgtcgtggtaatgaatggagcttgctggtagcgctggttatcttgttggctggtagcctgctgcgaatcattcccagcttgacagccttaattgctggtactttgctcatcggatttggtatctctggcggtaacgttcttttaccggcaatcatcaaggaccaatttccccacgctatcggtgctaaaaccagtctttataccgtgacgatgggacttattgcgtccctcggtactggactcgcaggattgctaaatcagcaattcaacatgcagatcaccctagcagctttttcgttagtcggcgtctttggattactcgtctgggcgttggcctttcgcacactaccaaagaaagcagcccggcaagacgtccagcgcaaaaatatcgccgtttcgcgatctatgctagcgtggtggatcgctttattcttcggcctgcaaagctttctctactattctttgctgacttggctgccaagtctttggcaagcggccggtttctcccaaatcgcggcaggtaatctggctaccatttttcagctgagcgggatgccggcaacattatccatcccattcattgctgagaagcgccatggcctcttatatagtgtctggggcatcatgctaggctttgtactaggtgctttgggtattcttatccctggggcgaactttggcttaaacgttgtctacgcgctgctcatgggcgttgcttctggggccgcttttgccatctgcattgtctttttccagaagaaaaccgccgatgcttatgaaacggctagtctctctggctttgctcaaagtgtcggctacttatttgcggcggttggtccagtattatacggcttcatccaaacggctacaggttcgtgggatttattgttgtggctgacagtcgggctcacgctgctgatgtttgtggcagggctgatcatcaatgcgaaccatcggatttttccatcaaaggtgaatagatagcgcttgcaagtttctattactttttttacactaagcatgaatggctaaggaggtcacaaaatggcaatgacaacgacaattggtaaaagtacggtcacaaccgggaaactaggtttaggcaccaataaagtcggcggccacaacttgttccctaatctgcatgacgaagatggcatcgccgtcgtgaaagccgcgcttgaccacggcattgacatgctcgataccgcttatatgtatggtttagggcagtcggaaaaattaatcggtgaagccacacaaggctatgatcgcagcaaaattattctagcaaccaaggcagcacaggatccgcacaatgatctcaaaccaaataacgatcccaaatttttaacgcaggcaattgatgatgctttgttacgccttaaaaccgattaccttgatattttctatattcattttcctgatgacaaaactgacaaagcggaggcggtcaatgccattgccaatgcccgcaaggccggcaaggttcgggcgatcggcgtttctaacttctcattagaccaaatcaaagaggccaaccaagacaatcaggttgatgtcgttgaagacaattacagtttggtacatcgtgatgctgagcaaaacctgttcccgtatttgaatgaacaccagatcagtttcgtcccatactttccactcgcatccggcttgttaactggtaagtatggccttgatgatgctgacaagtttagtcgacgtttctcggcagatcagttcaagaccattcttgccgctttgcgagaagtcgatggcatcgctgatgcccatcaggcaaccttggctcaggttttcttggcttggtacatgaagaatccggccattgcggttgtgattcccggtgcccgcctacctgaacaagctacaagcaatgctaaagctttagacgtcaatttacgcgatgctgaatatgcatctattgacgagttgttcaaaaaattccgtactgaataatcgcgcattgttctaggctacagacttcgcacaatccaaaaagcagcccgcttccagcatgtcacacatgcggaaacgagctgcttctttttattatcaaaaaacggatggtgagcaggcatcactcactttttgcgtctaaatgcccgtttgataacctgccaaaacgtcagtgattgtacaattttatctgccgggaaatgatttctgatggcgcgcaaaacgcgtttcggatctcttgccgcgaaggtatatgtcccatttttcttcgttttgattgcaaaccgtgggatccatttgcctttaaagatcaccgacgcaatgaccaaatcaatctcattccacgggatctgatagaaatcgcgcacgtttttttcgttgaaaaattcaaaccctttatcgccgatcatgatcttgccatatgtcggcatccccatgaaggccgtgccttcgaccactaattcggacttcgtgttgatcgattgaaccattttccgccatccttttaaactcatcttgaacgattttttactgatggagacgactcggtctgttctccaaacgcaattacagttgcagaaatctcctgttcacgctctaaacgcgatcgccagcccagaaacctgcgtgtaaggaccttgggcgcaatggccaaagcccggccatcacacccaaggccacttacactacgatttctaaccgctcctgttcacgctctccattataaaacaaaagcccagactttgcgcctgagcttccgtgattctttgttcgttttaacggttgatattacatcaagccgacaacgtggaagacaaccccgacaacgaacaggccaaggataatcacaattggagaaaccttcttcttcagtaaccacatgcagaacaaggtcagcagtaagcccatcaaaccaggaatcaagctatccaagttatcttgcagcgttaagaccttattcttggtcagtgacagaccttgagattgtaattccaaagccttctgaatacccttggatccacttggtagtgaactccagtcgatgtaagcacccttttggttaggtacgtctgatacgactggtgtgaatttaacagaaacccaacggttaaccagcgaccctaagataaacatcccaagaatcgtggcacccttcgtaacttcttgcaacagaccaccggaaaggtcttcggtaatcttgctcccagctttgtagccaaattcctgcgtgtaccacaggaaagccatacgaattgcattccaaagcacgaagtacaagattggtcccatgatgttaccagccattgccaatgatgcagctaaagcaccaataattggcttaaccgtgaaccagaacactggatcgccgacaccagccagcggacccatcatcccaactttgacaccctgaatcgccttgtcatcaattggcgccccattggcacgttcttcttccagtgccatggtaacaccaataattggtgatgccagatatggatgcgtgttaaagaattctagatgccgtttcaaagcagcggaacggtcttccttggtatgatacaaacgtttcagtgccggaatcagggtataagcccagccaccgttctgcatacgttcgtagttccaagaaccttgaatgaaggttgaccgccaccaaaccttgattcggtcgcttttagttaaatgaacttcttcagccatgtttgtcaacctccttcttagtagttgtcaatgatgtcgccgacaggatcaccggcaccactattcgagctgccgcctttgcttgagccgccgcccattttggacagagccaagtaaatcaacgccagagagatcccgatggcaccaaggccgatcagggtaatctctttaactgttgccaaaacaaaaccaagcgcaaagaatggccatacttcacgggtcgccatcatgttaataaccatggcatacccaacggcaacaaccatgcccccgccaatgccaaggccagcggtcaaccagtcaggcattctttcaagcaatgcccgaacaggaccagcaccaacggctagaatcaagccagctggaatggcaatacgcaggccttgcatgcagatcgcaatccattgccacatatcaatctttcggaaactgccttcttcagcagctgcatccataaagtgaacaatcgcggttgccaaggtacgtaccaaagtggtcagcaacaaaccggcaacagccagtggaaccgcaatcgcgatcgctgaactgataccttttgtgccctgaccgccaagaaccagaataatagcagatgcaacagatgccaaagcggcatcaggtgcgacagcagcgccaatgttggcccaacctaaggcaatcatttccaattggccgcctagaatcaagcaaggtgccaaattgccggtcacaagtccgatcaacgtgcacgcgataactggctgatggaaatgaaattcatccaaaataccttccataccagcaaggaatgacacgatgaggaccagaatgacttgaataaagtttaaagtcataagtcttcttcctccgtttcaaaaaaattacttctgtgcattcagttcgtcttgggctttcttcaaaattgcatccatgttctcggcatggtctgcaggcaccttgcgaacatcaaatttgacaccgtctttttccaattgatggaaagtgtcgatatctttttgatcaaaggccaacaccttgttcggctgaaccttaccaactgaatgggacatggaaccaatgttaagttccttgagtggaacgccgccttcgattgctcgaagtgcatcctcaggtgtttcaaataatagcaatgcacgttgcccgccgaaatgcttatcgtctttagcgatcttaatcatctgatcgataggaataacatgcgccttaacgcccgctggtgcagcttccttaatcagattctttcgcaagtcgtctttagcaactgaatcagagacaacaatgatgcgtgtcgggttggttgtcttggtccaggttgtggcaacctgaccatgtagcaaccgagaatcaacccgcgccagaacatactcaagtgagcctggctgaccagcattcgaagtagttggtgctgcttgagcagctggcttcgtcactttgtccagtgattctggcttgatcttgataccttcacgtccagcatcgagcagatgtgctgcaatatcctgtgcagaatccatcgaaagtcgtgaaccatacgcttcaatcagcatcggtaaattcagtccggtcacgattgcccatttatccttatgcgcctcataaatcgagttcgcttggttaaatggtgagccgccccataagtcgatcaagaaaagcacttcatcgtctgggtcgaacttagcgatcgcatcttcgaggtgcttgtgtaagtcatctggaccttcatcgggcatgaaggtcacagcttcgactttttcttgctcaccgaagatcatttgaccggattgcttgatgccagcagcgaattggccgtgactagcaagaataattccgaccatttttacgcctcctaaaaatttgtggttgccttgaaaataatatctgcaataaacgaaaataatctaaaaaacaaggcttcccaatagaatagtatgacgtccttcgcacagctatgcaagcattttcacttgaaaagggtgcataaaaagaagcgcatacattctctatgcacttctgaaaagcgatttcgctgaattggtctattggtaagtaccaattttgcctatgttggattaagccttttgcgaatattgatcggaatcggtaaagactgggtccaaaattttagtgctcatccaaatcaaaaccaaaaataatcctgtcgccaaccctgccataacgatccaactaacatgagcactagcaaggttcgcaatcgtgaagaaaatcacttgtcctactggcatgccgatcaatgctgccaggttgaccacccctgctgtcgtacccatctgctgttcaggcacttgccgcatcatcacggtggctaaacgtggattgattttgcccatcagatatgctgtcacaaagctgaaccccagtgccgccatgatcgaatggagcaggaaaaagctgctgcttaaccccactatggccgccatcagcagacttagcaatttgaacgtgctcaagcgctgcaaaccatccttggcaaataaagctccaaagataaggccgacagaaaacacaacattgatgattgcaacggtggttccaaagtcgcgcagccataggtctggctcctgcacaagcgtgatattcatcaacccgtcaacggatgagccaagcgtattgactaacatcgcgaagagaataaccgcgaataggaattgattgccagcaagaaacttaagaactgcccggatgttaccgataactggctgtgacttgcccgttgtcactggcggttctgcttgcttcaattgcttttttcggaagacaagcgtcacagcggctagtaaaaaggtcaacgcattgagcaagccaaaaagtgcataattgtgattcaataacacgatcaaactggctccaagcccttgaaaaaccagttgcacggttgaactcgttgcactttggaaacttaaggcagtgttaagctcttttgcgggaatcaagcgatgcaagagcggcagcgtcaaaccattgccgtactgacctaacgaatcggaaacaatattgattaaaagtaatgatagaaatagcggaaaactggccggtagtaaaatcatgaccgctaaacttaggaacaacaacatttgtcccaaacgggttgccaccatgtgccgagttttagcatgtgtccgatctgccagactcccagttaaaagcgacagcatggtcggcacgctggttgccatggcggctaacgtcaccgccagacttttgaatggcatagttgcggcataaatgatgaacacaatattatagaggctatcaccaatcccacttaacaaactggcatttaaaatcgcacgatacccgcgattggtaagatattcatgcatctcaatcttcctcctcaaggtgcttactggtttctagacacgcctatgagctttcaaaacgcgttcactgccgcagaaacctgctcataaggaccgcaatcttaaatggccaaaaccctgccatttaaggttgcgcccgcttatgctccggtttctaaacacgccagttcacgctctgcttatttgtatctagagtgtacgcagggtaaaatcggattgaggtgaaattccactatggtagaaaaaataaaggccacagatggtgcggtttttcggcagttgcgacataatcatcagctaaccttagcgcaagtggcagacgaccataattcgattgcttttatcagtaaatttgagcaaggcaagtctaatatcagcttttcgcgtttaacccatttgctgtatcgcattaatatctctgtcgaagaatttgtttttatccgtgatcttcaatccggcgttgtgccgacatcgaatgatcctaattttgtgtacaataccttaacgcatcgcgcctttgtcgaagtgcttgactatcaggatcgcttttcaactcaggaaccgacaccagcagactatgcttatttcctcaaaaaggagcaggaatggcaagctcgttatgcccaagaccacaaccgccaaacccgcttcgagctgatcagcattcaactttttcggctaaccatgattgatcgggttaaacaattaaaccaaccatctccattcaaaagtgtcgctgacgctatggcccagcttcaggctttggcaaagccggtcgtgagttatctttattcggtcgaaacatggaactactttgaactctattggtttcgccatcttatggtcgccttaccgacagccacgattcaaaacttactgccacttgccatcaaacgctcggaaaagtatcgtgcttttaaccaaatccgcaatatccgaatcaggacactttttgcggccttctccgtttttattaatgatcggcagctcaccgatgcgaaaaaagcgctcgatactgccaaaactttattgcatgacagtgacgatttgaccaacgctgctatgttactttttttacgcggttggtatcacgtcatcgccgatcagcctgaaattggctgggagttgtgccatcaggctattagcttggcacacatccttgatcagcctaaacaagaacaacagttgcgttattcattagaatttattcatcaaaatgtcaacaatccggaaaaaagtgctttcttcctttaaacttatttatcggcagttgaagtttcacgtggaacttttgagcatttgcaagacacgcttctggcaatcttctcactaatggcgtcaaaaatcggtactggaaagtgtcttttctcagtaccgatttttgcctgcatgattgctggcgcggatctttaagcttcttggctacacccttttgctgctgcaagccgttcaattgcaggaagccacgtcgccgtccatgctggtgcccccaattgcgccagcattttttttaattgcaaaaactcttgccgtccttgtaacgccaccactttgtcggatgaataaatcataagtaatcgtttcacacaagcaatctgaaactcaatgcctagatcaccaacagttgcttgcccgataagattcaaagcatttcgtgcctcagtcaatttacccgctgccacatagcgaagcacagccgctagaaacgtgcggttagcaagattaaaatgatcctgcggcgtgttaggacgttgaatctgatttgaaaaagcagctatcaattgactcagctcatccaggccaataattttagccaattggatggcaatcagtcgtaatagtaacgaccagtcagccgtcgtcatcagcaatgactgcgcttgtgattgctcatgcggtaaaattgaaaagcgttccggcgcgtcattatgtaaggtcaaatgcaacaacaggcgttgattaacattggcgagtggcaattgacgtaaaatgctggccaattcctgaacgtcagcgtgacgcgcagccgccaaataacgttgtaaaaaaggttgcttatccctagaacgaggttttgcaaacacatcccaatctaaattcaactgatccaacaacaaaaagaaacgatcagcagctaactgtgaggtaccattttcaaactttgacaaacttgacaccgataaaatgccatgcgctgccatttttaaagtcagtcctcgttccctacgtaataacttaaattgtctaccaatcgtcatctcgcagccccctcctccttaagaaaccgctgccaactagttgttaacaattgagcaaaaaatggtgactctaataaccgcaaactggctaacagttgctcaaccgctgccgttgctgctcgatgcttaccgcgatggtacaccaataattgctgctgataccgaagcatcaatcgggaatagagatcatccggcggcactggcatactggtcgcaatggttagcaagcgaactgcttcactaaactcacgccgatggatcagtaacgcaatgctattcgtgagaatcgcccacaaatattgatcgcgcgtccggtgactctcggtttttggcatatccagtaacatccctgccactaaactaaccaactgtttactgtcgaaaagcaccaacgtcgccgcaaaaagatccagctcataaagtccccagtgcttaattcgttttaagtaacgcataacgtcagtcttcatggctggtgttgtttgaaaactcgggtcactgaacccgttgtgcgccatgatgttaatctgattaagtcggtaaaaaataagccccgtttcccgccataaccgatactgtcgcttagccaatgccagtagcgccggtttcccagcaacagtcgcccggttcacctgctggaaaaagttatcctgattcaaggcgcggtatccttgttgaatggattcaacgtcttgatcaaaccgtgttaataattttaaaacaactgccgcactcagttgcgtctccccacgttcaaaccgcgacaaagttgcagctgtcgtaatcccagctgcaatttcttctaatgaatcattttcctcgagacgtaaagcccgcaaatatgccccgattttgacatgttcttctggcatcagcacccgacccttttatgagaactttattagacaaacttaacacgttttgccattttttcaaaatatcttactacttattgcacctcaaatttgaatatttttgtttttaaacgctgcctaaacatgggttgctagtcccaagaattttttacgcatttttctgatagacatcaggcagtagcgaaaattcaatggacgcggccataccagcgccttagccttggcgatcgctactccgaattttcacaaaaccagttcagactatcgaagcctgcccaacaagcatcagaagagcgaatccttctactgtgccatctaaaacgtgtgagcagacgtagaaactgtacttgctcacgcgctgccattataaattgacatccatccctgactccgctaaactcaattttgacatttaaatacaccaccaagaaatagaggttgcggtgggcaacgaaaactggggagtgccgtatcatgttgaaccagttgtaagtgccaccgccgaaatgttgcacgatattcggatcgtgcgcattgggccatgggtgcataacccatggactgtcgaagcactcgcttcggggcgctatgattctggtttatgactaaaatcgatggaatcgacctttattgcggtatcacaacacaataaggtcgattttttgtttccagctctatttcccactacaagaagggagaaatgtcagttatgaaaaagcattgggttgcacgtttaggcgtgctggggttcgccttgagcctcttactaggcagttttgctgccaccccggtcaatgctgctagtgatagcggcacgtttaaagtcggcatggaggctggctatgcgccgttcaactggacgcaaaccaccagcgctaacaacgccgtcaagattcaaggtagtcaggaatacgctaacggctacgatgtgcagattgcacgtaaggttgccaaagccttacacaaaaaggtagtcgtcgtcaaaacatcttgggacggattgccaccagctctaacttcaggcaaaatcgatgccatcatcgccggcatgtcaccgacacctgatcgtcgcaagaccatcgatttcagtaatccctactacatctccaacttgacgatggttgttcgcaaagacagcaagtatgccaaagccaagagcattgcggattttaagggtgctaaaatcaccgcgcagctcagcacctatcattatcaggcgatcaatcaaatcaagggtgtcgtcaaggaaccggctatgaacgattttccggctatgcgtgtggccttggaatccggaaccattgatggttacgtttccgaagtgcctgaagggatcacggcagaacgtgctaatcctaacttgatgtatatccattttgcaaaaggtcagggttttaaaaccgatgccagtgacacgaatctggcgattggcttgcgcaagaatgatccgaataaagcaaagatcaatgaactacttgccacaatttcaagtaaagaacgagcacagctgatgaatgaagctgtcgataaccagccatcaactgagagcaatggcaactggttcatcgcgattatgaagcaatatggtccaatgctgttacgcgggacaggcatgaccttactgatttcccttgttgggacaatcgtcggctttatcatcgggttgttagtcgggattatccggacaactcctaagccgaaaaaactcggtcagcgcggcttacgcgccgtgatcaactggctgctgtcgttgtacatcgaagttttccgtggcacgccaatgattgttcaggccgcggtcctatattatggtgccgcacaagcttggcatttgaacatggaccggaccaccgctgccttattgattgtttcgatcaacactggggcctatatttccgaaattatccgtggtgggattatctcggttgacgaaggtcaattcgaggctgccaacgctctgggaatgacccatctgcaaaccatgatgaaggtcattttgcctcaagccgtgcgcaactcactgccagctgtgaccaacgaatttattgtcaacatcaaggatacgtccgttctgtccgttatctctgtctccgaattgttcttcagtggtgagactattgccggacaaagcttccaattcttccacacctatctgattgtcagcgccatctatctcatcatgaccttcacaattagtcgcctattccgattaattgaaaaacatctcgacgggccaaaagattacaacgtcatgaccaaccagatgcaggtcgaaaccccgaaaactcgtacggcaaaggagggctaatccatggcaaacgaacctttaatccaagtcaaaaatttaaaaaaggcctttggcaatcacgaagttttgaccaacatcaatctggacgtgaatgccggtgaagtcgtttcgatcattggccgtagcggctctgggaaatcaacacttttgcgaaatatcaaccttttggaaaccccaactggcggggatatccttttccacggaaaaagtattttaagcgatgaagagaaactaagcacttatcgcgccaaagttgggatggtcttccagagtttcaatctgttcaacaacatgacggtgttgcaaaatgtgatggttccgcaacaaacggttttaaagcgcgatgctgccacagctaaagcgcacgccctcgacttgttgaagcaggtcgggatggatccattcatcgctgcaaaaccggaccaattatctggcggtcaagaacaacgtgtcgccatcgcgcgggctgaggcgatggatccagaagtgttgctcttcgacgaaccaaccagtgcacttgatccggaaatggtcgatgatgtcttaaacacgatgactgctttggcacatactggtttaaccatgatcattgtgacccacgaaatggccttcgcgcgcgaagtgtccgatcgggtcgtcttcatgaacaatggcgttattgccgaagcaggcacaccggatcagatcttcggcgatccacagcaacctgaaacaaaagagttcttgaaacggtacttgaaccgaatctaaacctatggctcgattcttgggcaacaagagcttgagacataattctcagtcaaacgaataaaaaggaacaattttccgattgttgtgggaaaaattgttcctttttagtttctcgtggattattttactgcgattttaaagaccgtagtgccaaggcgaagcaatcgtaggccagatggggctcagccgtgcaaacaacacagcgactgggctttgtcgctgatgttgttaggcgacttcgagaccgcgggctttgcgggctcgaagcgccgtctccgctctagctccgcgtcgccaccccagctggccggagattgcggagtttggcacggcaaagaacttttaaccaagtcccttttacaacgattttacttttttgactgctgctcacgcttctgcttgcggtgttcgctccacgtatccaagctcaccacaataagaaacaggaaaaagccgccaacgaccgattctagtgtcaaaatcaaataacgcatggccaagtagcccttaccgcctgtgacatcccgatagccgacgtagccaaatgtcatgagaatagccagtcctaaaaccagcaacgtgtacatcagcgttcgttttaaaatgcgtttgaatgtcgtcatgcggtgacctgctttctaatgagtcttacttattatctttcaaaatcgtatcagcttgcttctgcaaattcgtcagtactgttttgggctcagcattttttgaaacggtttggtccacagcatcaagcaagttattgcggtacgtattgtaaccaataaatggcgttgaggagaacgcatcgtcataagcatccactgctgcctgataggtcggattctctttcaagtaggtttgatacgcgctggactgggttgcggtcttcacaaccggcacataaccgctagccttagcccattgcgtttgaatcttggtgctcatcaggaatttcatgaaggtaaccgcacctttgatctgatcagctgaagcgcctttgaaaacggaaatcccattgttacccagtacagaactggccttgccagcaaagcttggcatcacagcggttccccagtgcatggacttcggcgctgttgctgcaatttgctgaatagtcgcactagagccaaacccggcaaaaattttaccttgaacaaatggcacgttaaaataattgtccaagccggcagtgaccgccgtcttatcttttaacatggtcgtgatggcggtcatagccttgatgctggccggtgtgtcaatttttgcctgatacttcggcgtgatcaggcgattaccagcatcataggccaaggtttcaaattcaaaatcataacttttgttgaatgcgaccccagtaatgccgtcgtctttgagctgctgactcattttagtcagttcttcccaagtcttgggcacactgagatggtacttatccaaaatatccttgttatagaacatcaatcgtgtcccagtggcaaatggaatttggtaatatttaccttcatacttcaagtttgtcgcaatgcccggataaatggctttgagctcatttgcggaaaattgtgacttcacctgactgtcaatgttaactaacatcccgtcatgcacgtattcaggaatgatcgtatcagttacctgcccaatggttggcaacatgcgagatttcgctgaagccagatactttttttgtaggttatcataagacccttgcgaagtagcaacaactttgtactgcttttgactgctgttgaacgtcttgatataaccttcaagcgccttgttataatttcctgtcatgcggtgccagaatgtaatcgtcactggccccttcgtactcttttgcgctgaactgccgctaccgcaagcaaccagcaggactgccatcaacactgtcacaaacccaagcaaccaacgtctcttcatcattttccctccattatcgcggtttgtcgtgaacagagacaacttgacctatccctattcggatataagtgcgttgtcgtcaaccacgaatagtataccaatacttaccggatcaaggggaactaaagtctaaaaaaagaaagcgtatgccttcttttttagcatgaagctatgagatgatgtcaggcttgttcttcggtcaattttagatagaaattagccagtgtcatcgtgcgatatggtatgacccaaattgacgctaagccaaacgtaatcatttccaacaaccaccaacctaggaaactgaggagcaaaacgaagaactcccacttatggccgtacatcaattgacggctgcgcgtgacagcctcggtatagccaattggctggccagcatcaatggcatcacgataaatcaactgggcttgtgaataagccaatcctttgacaatcccgggaacaaccaataacaacatccacaggctgacccaaacgacttgcagcaaaccgatcagcaagctgccgagaaaatattcgccacgttcaaaaattttgaacatctgtgtccagctaaaccggtgatccgacctaccgcgcaacccatcaatcatagcgaagctgacaccgatcatgagcagcgctgtcagcaaaccgataaatgtcactgctgtctgccacattgcgatgttgttccaataaccatttgtcatcatccgtcggctgccatgagctacgacacggataccagctcgatgcatattttcattaagcgggaatggcaccagcgccacaaaggctgtcaataataatgccggtaaactaatccgtaaataatagctaaagttgggattcagctcagccttggcctgatcttttaaagaagtacgatccatagatattccccctctaactgtgacaagtcatcacaatccttggggttatcataacagaaaaagacggttgagttatacaaacttcaaccggacattgggatcaagttgcggttcaccgggaacaatagcaaagtgatcaccgctgactgttaattctgtttctgctttaaaaaacccactcgtataacttttgatcaataccggccccaccggcgaatcaaggtgtgcatcatacacatcgggtacattggtacgcggtagaatcaataaattgaatttcgcctgtcctgatgtttttgatggccgtgaataaggaccaataccgtcattaatatcaaggattagcgccttatcggcatgtaacatcggcgccaatcgtgaggcggccacagcagatacattaagctccatattttgcccccaaaagtaaaataatccttgtcaccaatattatggcgcccgaccgatcaagatacaactctcttgtaaaaatttcaccaaatgcctaaaattgggttaaactgaatttaacccgatgtgattttattcagctaggacgaggtgtgccatgaatatttattcggctttaaagtttatccaaatcgatcatgagccagtcaatcacctgcaagttgtcatcactgatcaaagcggcaagcctgatgccggcatgaccgacttattggctgactgcttgaacaaaattgacattttcgttgaccttagcacaaccgatcgggtcagcgatgtgattgatgacctcaatctgctcaccccgctgccctatgatgtccttgaagaatatcaaaaaattcttgagcagccgatcaccggcgtcaatattgcgatgaaaaagcagttgatcgagttgatttacgcaccaatggtttaggtttgtttattttatcataatagcgcggccatttttaccggtgtcttatcccggcgaagatgacgcgctttttatgtgcctgcggaatcccttctttagtgaaaaatcttgcctgattcttgttgtaacagtttcacttaggtctattttctgctattctgacgaaaacggaggcgaggaaatggaacaaacgggacaagcgctaccagcaaccattcaacgaatttggcgggcaagtgcggcgttgtgggcgctagtgctcatgatcatcggtttgggactcattgccgcttggtttttctggcattggtccttttggcttgggttgggtcttattggcattgcgattattcaactgctgttccgattagcacttgtgccgtatcgctatcgtttttggcgctacaacatcacgccaaccgcggttttcttgcaaaaaggctttttcttccaaaaaaatgaagccattccgatttcgcggattcaaaatgtcacgttagaagccggtcctttacttcagtggcagacactgcaacaagtcaacatcgaaaccgccagcaccgcccacgtgattgatggtgtgacgcgaccagtggccgaccaattgcgcaatcaaatcctccaattggctcaggaggcgcgcgatgaagactgaccaaccgcaacgactcgcgcctgtcgcgctactaattatttggatcagaggctttatttcgtggtggccgttatttgttggcggagggctttcaatactgcgcgcagacatgagcttcaatcaatttctattgtggggcggcctaattgttggcgttttggtactcaccctcatctggtcaatcctgcattatttgcgatttacctatcttgttgccccgaacggtctgaccatcaacagtggtgtgttgattcgtaaagtcaatcacatcccttatgaccgtattcagacggtacaacggcaacaatggttttttctaaagccactaggtctcgaacaggttgccatcgaaacagctggcaaagaatctaaaaaagccgaaggaatgctctcggccgtgccagtagccgtagctgatgccatcaaccgctaccgtcaaggaaacgttcagccagtgacacctgatgcgactgataatcaggctatccctgctgcacccgatcaaacaagcaccaccgccgcaccagccgcgcctgtggcagatgcggcctataaaatcaacggccatgatcttaatcaatacgcgctcacttcactaggcttcatccccatcatttccgggattctttggttaacacaaaaagctcaagaatacctgccagatagctggtacaagaatgctgagcatgccatcactggcttagcggtttaccttattatcggtctgacacttattattctcattctaggtttcctgatctcctatttgaatattattcaaaaatactaccacttcactttggaccgaaccggtgacgaactacgaaccagccgcggcttttttcaaaccaatacggtcagtgcccgactgtcacgcttgcaggcggttcgctttaagcagagcattttgcggcaatggctgcatcttagcaccgttcaggcgttattagcctcaagcgccgctgatgaccagcaaaataatgatctggtcctgatgccggttatcccagaacggcaagcactcagcagcatgcgggcattcgtcagctggttgccggaaacatcaccgaaactacagccaattccagttagcaaccgctggtactacatgcgcaacatggtcctaggtcatctgacactattggtgttgccggttgtgctcgcaagtgtgttttggttgcacgtcagttggtggctgtggctggtactggctggcttgatttggttagtcgtcatggcgttgcaaggtcaatatgcggcaaccacagccgccattgctattgcgccacctaagcaacttatcattcaagtcggtgaaatgtggacaaggcaacgttattttgtccgtaaaaaagacattcaggccatgacgatcaaacaatccatctggatgaaggcgcgtggcgttgcccatttagaggtgcatattcgcaaaggcaacagcgatcagacagtcaactcccgctatatggccgttgatttggccaagcagattatgacttggtatcagccattaccatcagtgccgcaagaaggagacaatcatgctgcttaatcgtatccagtacaccccaccaaaatcaaaaaccgcgtatccattcaacttgccttggcaagcttcctttcgtgacctgacattgtcgcaactcgtcacggttttgacaggcgacaatggtagtggcaagtctactttgctgaatgctattgctgctaattacaatgcaatcctcatgagcggggcttcccttgatgaggacccggaatatcaaaatagccgtgccttagcccgttgcctcaagttgacttggcaatatcggacgaaggcaggctttttctttcgggcagatgattttatctcattcattcgcgcaacccgtggccggatcaaatacgcgcagacacagcttgagcaactggcacccgatagtttggaacgcttgccttatctcaatacactcagtgccattcaccatctttatcaagttgatctcgacaagctttcccatggtcaggcgttccttgctttatttcgtgctcgactgcgtccaaatgcactttacctgctagatgaaccagaatcaccgctcacgccggaaaatcagctcagtctattagccttactacatgatgcggtagaaaatggctcgcagtttatcattagtacacattcgccgattctcatggcctatccgaatgcgcaactactggcgttgggtgacacactagcacccactcaatatgatcaaatcgaacatgtcgcttttctacgtcactttttagatgatccgcaacgatttatttatcacctgttaaacgactgacccgttgcaatcacgcacctggctgttctaaggtgggggcgagcgatctccagcgcgggtaactaggctggagatcacgttaatgaggaggaataatatgctgacttcatcttggatcaaacaattaccgctgaccgccatcacgcaagtcaccccggttggtggcggtgacgtcaatcaggcataccggatcgatacggcgacaaagccttactttttgctggttcaaccgggttatcctgctgacttttatgctggcgaaatagctggcttaaaagcatttgacgaggcacaaatcttagcaccgcgtgtcattgctaatggtcaaattgaaggcgatggttttctgctactcagtttccttaccagcggcaatggatcgcaacgcgatttagggcgattagtcgcgcatttgcatcaacatcatgaaccaaatggtcgattcggctttgactacccttatgcgggcaccagcgtctcatttaccaacacctggaccgattcatgggcagatctattcattcaccaacgcttggacaaactcgccgcacacctgcttaaaaaggggctgtggcaagccgacgatgaagcgaccttccaacaggtgcgcaccatcatcagcaaaacactggcccatcatcacagcgatgcttccctgctgcacggtgacttatggggtggcaactacatgtttactgccgatggtcagccagctctgattgatcctgcagcagtatatggtgatcgcgaactcgatatcggggtaacgacagtttttggcggattcaccccagacttttacactggctatcaagaagtctacccacttgatgctggttatcacttccgccttgacttttaccggctgtattatctgatggttcatcttgataagttcggcatgggttacgctggcagtgtggccgcagtgatgaatcaaattctcgatcatggcttagctgaataaatcgcttcgctatgtattttcgaaacgaaaactatttcccaggaaattaaaacagcaaaacggccaacccactagttgatggattggccgttttgctatcttctaaaaatcaatatttaagcgttcagcaccttgttcaggaagctcttggtccgttcttcctttggatgctcgaaaatgtcttcaggcgtgccttgttcaaggatagtgccattgtcaaagaagacaacccgatcagccacttctttggcgaagcccatttcatgagtcacgatgaccatcgtcatgccttgcttggccagccgccgcataacacccagcacatcgccgaccatttctggatccaacgcactggtcggttcatcaaacagcatgatatcaggatgcatcgccaacgcccgcgcaatcgcgacacgttgctgttgcccaccagaaagctgagctggcatcgcatctgccttgtccgtcaaaccaacaacttccaacatggcttttgcctgcttgatggcttcctccttgctggcgattcccagctcggttggcgccaaggtcacattacccatcactgacatgttcgggaacagattaaaatgctggaacaccatcccgattttttcacgaactttgttgatgttggtgcctttatgggcaatatcttcaccatcaatcaagatctcaccgcttgtgacggtttcaagaccgttgatcatgcgcaggacggtacttttccccgcaccggatgccccgatcataacgaccacttcattgttcgccacattcagattgacacccttgaccacatcattgtcaccgtaactcttgtgcacatttttcatttcaacgcgataatcgctcatgccttcaccttcttctgaacccagttactcagccaggtcaataacgtaataataatcaagtaaatcaaggcgaccatcgtccagatcttgaacccttccatgttgcgggcaatgatgatcttcccggtttgggtcagttccagcaagccgatgatcgacaggattgaggtatccttcaatgtaataataaattggttgatgaaacttggaatcatgattttgattccttgcggcaaaataaccttccgcatcgctttaccaaatggcaggcctagacttcgcgccgcttccatctggcccggatcaaccgcctgaataccacccttgacgaaggctgcggtgtacgcgccttcgtttaaggtcaaagtcacaatcccagcaatgaatgctggtacttttgatccaatcaggcttggcaccccggtatagataaacagagccaaaaccatcagtggaagaccgcggaaaatgtaaatgaaggtcgtcgcgaccccttgtgcaaatttatttggcaagacgcctaacaatccaacaagaatcccaaccaaggtagcgaagaaaatggcgacaaccgtgagaaccattgtctcttccaggccgctcattaaggtgccccagttagccttcaacaaaccgaagaaagaacgatcagttgtttgcgcattgccagcggcagttttttgggactttgcactgccgttgccaagataacgttcaatgatcttatcgtattggccgtttgcccgaagtttcttcaaaccagcgttaaacttcgtgatgagcgcccgattattcttcgaagctgcaaagccgtatgaaccttcacgggctggcttaccgataattttcaaggccatgccattgttgatcccgtactgcatcaccggttgatcttcaaaacaagcagctgaattacctgtgatgacgtcctgatacatattgttcgaatcatcaaatgtcaccgttgaaaaaccgtatttgtctttaatactgttggcataatccgcagaatcagtcccggtcttaaccgcaactcgcttaccgcgcaaatcttttagcgacttgatagtccctttttttgccaccgccatgaccacgcctgatttgtagtaaggatcactcatcaaaaacttttgttgccgctcaggtgtaatcgacatgccagcaatgacaccatcgatttgcttagcttcaagtgcttgaaccgccgcattgaatcccagcggcttgatctcaactttaaaaccttccgttttggcaattgccttaatgagatcaaggtcaataccgacgtacttgttatcctggttcgcaaactcaaacggtgcaaaggtcacatccgtcccgattgtatatgttttttgtgccgctgccactgacttgccgggtaataaagctcccagcattaaaggcagggcgattagcagccctagcagccattttcgtttcaaccctaacaccacgctttctatgatatccgattgcaaactcgtttagcttgcaacaaatgcgctttctgcccacgatcaggctgacttaagcgaccttaattaaaaaaactactttttatgctagcggaaagcaacagtcgctgtccagtcctgatgttagattaattgacatttgtcacattattttacgccaacggtctaggcctccatacgccgttgaacccaattactgagccaagttaatagcgtaataatgatcaagtaaatcaaagcaaccatggtccaaatcttaaagccttccatgttgcgcgcaatgataattttcccagtttgggtcaattcaagaataccaatgattgagagaatggacgtatctttaagggtaataatgaattggttgatgaagctcggaatcataattttgatcccttgtggcaaaatcacgcgccgcatcgcttttccaaaaggcaatcccagactgcgtgcggcttccatttgaccatcatcaaccgcctgaatcccacctttgacgaaggccgcggtgtacgcaccttcgtttaaggtcaaggtgatgatcccagccacgaatgccggaatttttgaaccgattagacttggcacgcctgtgtaaatgaataaggccaataccagcagcggtaatccgcggaaaatgtagataaatgtcgtggctacaccgcgagcaaactgatttggcaaaacgccaagcaagcccacaagaatcccgacaacggttgcgaagaagatcgcgataatcgtcacaatcatggtttctttcaagccacccatcaaggttccccagttttcgcgcaataatccgagaaaactgcgatcactatcttgagtcttggcactggtttgtttttgggcggcttgtgtgccattgcctaaatacttggcaacgattttggcatatgtaccgtcagctttgacctttttgagtccggcattgaatcgttgatcaagatgatcgctacgatccttttgtgttgcaaaaccgtaataactggccttactttctggaccagccagcttgagcttcaaccctgtggcgatggcatattgcagaaccggtttatcatcaaaacaagcgaccgaattgccagtgatgacatcctgatacatattgttggaatcatcgaaggtcaccgtggtaaaaccatactttgccttcaaacttaaagcatagtctgcggctgccgtcccagttttcaaggccacacgtttgccgcgtaaatccttcaaacttttgacttcgctattttgccccacggccatggcaaccgccgttttgtaataaggctcactcatggcaaacttttgctgccgctcaggagtaatctgcataccagcaatgacaccatcaatctgattagcttccaaggcctgcacagctgcattgaaccccaaaggtttgatatcaaccttgaaaccctcagcctttgcaattgcctgcatcaggtcaatatcgatcccgacatactgattatttttatccgcaaactcaaacggggcatacgtgacatctgtgccgatcacataagttttctcggccgcctgcgttgacaccggtgagcctagcacgaccgccagcatcaacgccatgaccccagcaacgcaccacttccaaactcgtctcatgaaaacaccatctttctcatttagttcctgtttctttcaaaaattgctaatgacgcatgctacttcaattcatgtgttttgagacctgtaaacccagctcccattcacagcttacaagtgtaccgatttttctaaaggttgtctacgcgcaagaaaagcaagattgctttatactaagagaaacttaaagaaaaatgtggtgaccttatgtttagctacctaatcgactatgatttgaaactttccctaccgcgaccggaaatcgacggtccccttttattcgaacaaattgagactagccgcgattcgttggctgcctacttgccttgggtcgtaacgacactgactgccgacgacgaaatcaactttttaaatacaacactcaagctttttggtgcaaggactgccttgcatctgaccatttatcaagccgatgctccagttggcatgatcagtttgaacacgatcgacaccttggttcgccataaagccgacattggttactggctaaccattcccgaacgcggcaaaggcattatgcacaaatccattgaagcattggccgatattgccttccacgattacgccctaaataagctaaccatcaatgccgctgtggcaaaccgcgcgagcaatgccgttgccgaaaaagccggctttcatctcgatggcactttgcgtcaagacgatcaacgagctgacggcaccttcttagatgtgaatacttattcgctgttgcgttcggagtgggcttaattgtttcatgcgaaacaattgtcacctccagctcaccacgccatatgaaaaccccgcttgcaaaatcagcatgcggggtttatttttgcgccctatttctaattaggtcaatgtacaagcagtcgcagcaacgctggcgtcacaaagccttcgattaaggcagcaacggcaatcatcggaatgatgatgcaaacatactgtagtgcaatagccttcgcatctaacggcgactttcgataatatggatcggcaaaaaaacgcttgattgactggcgaagggccttgttgacttgagcagcgagcgcgacgccgataatcaaagcactcatctccagaataccatgtggcaaaatgcctaagacaaacgctgccaaagcaccaccgatacccagcttagcggcataaatgcctagcaccaagccgacagaagcacaggtgagataatacgaaatccaatatagaaaaggaatcggaatcataccaatgatcatgaggccaaaggcaacgcgttcgttattcactaaaatggaccaaaatgcactgagactgtcgtgagtattagcaaacttgccagagaggccagtaaaaataccacgaacaaagttggggttcgcgcccatgaccagatatgtcaccagaccaacaaaaatggtgacaccaaagaaaatgagccaaccgatcaatagataatggccaataacattcaaattgtatccgagccgtttcttcataggttgcccctctttcctaataacagatgctagggtaagtatactccagggtggaaagggtggctattttgagggtttggcggtatgtatcatttttctcctaatcaggccttctcctattatccaagctgagtgtccatcagttctcactagccgttacttatccaacatcgtgccacgaactgggacgtttggcgtcgcctattttcttgttctgccttagcactaaaattgaaatgacgctctgaataaatgcctttataaactataaacagcgtttcacatctttcgccatgccagccgtcagttcgcatgcttgctgtttagctttttttcgtgaataatgacggcatggaggtgtcatgatggaagtcaatgaagcacaagccatttttgatgcagcacgggatcaagtagcgacgattgtggtgggcaaatctatgccgatcacattgactttcaccgccttacttgcaggtggtcatgtgttgttcgaggatattcccggtgttgggaaaaccaccctcgttcaagcgatggcaaaaaccttagcggtgccattttcccgcattcaattcacacctgatatgctgccaagtgatgttcttggcacatcaatctttaatcgggccactaatcaattcgaatttcaaaaaggacctatttttaccagtattttattagcagatgaaatcaatcgcgccacgccacgaacacaggccgccttgttagaagccatgggtgaaggacgggttacaacggatggtcatacctatcagctagcccctgacttttttgtcatggcaactgagaacccgactgattatgcagggacttacccgcttcctgaagcacagttggaccggttcatgcttcgcctctcacttggctacccagatgctgacgcggaaaaaagtttgctgctaacgcctgatcgtaaaacgatgattgctcaattaacacctagactagacgcatcgttactagctgaaaccaaaaaactcgtggctaacgtgacggtcagcgatgcaatcgccagttacgttctcgcgctagtacaggcaacccgacacgacaaccgtgttcggctaggtatcagcccgcgtggtggcattgccttggtcactgccgccaaagccttcgctacgcttaacggacgtacttacgttgatccaagcgatattcaaacgctactcgatcctgtttttggtcatcggctcattgccaaggatccgacactttcgacggcaacgatcttagcagatattctgcaaaacaccgccgttccgattcgggggtgagcacatgaactggcgcaacttttttatcaatgctggcattttgcttgtgctcagcctgctgatcgtttttggcgtggcatttaactcatctaccagctggtttgccagtgactttgctatcctgatactactacttgcgataccgctattgtggccattgaaaaacacactgcgtttcacagcagataatcctgacatgatcgccgatagaccggtaacgcgccttttcacgctgactcatggcagatggctacctaatctttttctgcttgacagtgccaaaacacatacatggcatttgccaatcggacaacggacagccaaaatcagtttaaccttacagcgcggcatttatgatcagttaccgatgaccgtcaccgtgactgatttattcggctggtttcgtaaaacactacccttgcgtttagccacaccgatcactgttggccccgcacgcagaccagaagctgccgcacgaattgcagatgacttttcgcaaaaaatgtctgctgctgacgctggcttgcccagtgaccgcattaaaaatttccgcgattatttcccgggtgataatattcaacaaatcgcttggaaagtcagtgcacatgccgatacgctgattgttcatgacgatgagcatgaaggtcaggccagctggacattgctgttgctaatcacaccaacgctgtcactcgagcctgccttgagcttattcgcaagtctcatggacacaggcatcttcagcgggaacggctatctgctagacagtcggttaacctccgtcatacaaggacggcaaaacacatcgctagccaactttgagcctgacggtaccgccacgcctgattccttagctgctttgaccaccccacaacatcagcatcgcgcctatcttattttaactgctgatacacaggccgcagtgcctttcacacatgcactggctccggctgctacaacactagtcgacttgtctggaggtgatgaccatgcctaaatggctacaacgtctccttaccattttgctgacatggtggttattggcactttttgtacagcctttctcggtgattaatccgatagcacatcctcgtgaactcgcaggctatgttgtcatcatcagcttaattagttatcttgccgcattatggccacgggcttggccaatttggctaaccactgctttcttgagcatgatcgttggcctttgggcaatactgccgcttaaacagcattttggtcttacttggtttaacacttatgtccaaaccttcaataccgcgactaggcggtttttgcaagttggtggcgttgatgtccctgcgaccctcagcatgacgttgattgtagctcttgtcgcctttctactattaataaccgttgttctccaactctatcctggcgcagtggccattgtgctcagttatttacttgctgtacatgttttcaatggcagcgacctgacgacacaatttttccagctcgctgttgttaccgggttgttggctgttttgcacctttatcacacccgctggcgagcgtttttaattggcagtcttagtattgttggcttaacccttggactcatgtggctcagcaccagcactccgttgaatgactggttagctaatatctctgttcctgcgcgcgaacgactcaatcagcgaggcttctatgccagccttgaagcttacgctaacggctcaggccgcacaggattcaccgaaaacagtcgtgttttaggcggtccggtatatgatgatcccacaccagtattcaccgccaccagtcgtgaagctcattattatcgcgtcgaggttgactcattttatacaggaacgggttggcgaccatctacatttcagacgcaagctgctcctttagacggtgctattatgcgtgatccatcggctcgagtcgattatggtcaagcaacgtcagtgaaactagtttttaacggcggtaaaacctttttgccattaccgtatgggcaattaacttttactggcggtaaaccagaccccacgaccgattttttgcttaactcagccacacaaaggataactgcgagcgatgatcaacgcttcgaacgcctcgatattcaggtgcagcaaaaacagtttaccgatacgcaactcgaaactgctacgagttcaactcagttaatttcatctagttatttacggcttcctagttcactaccgcaacgagttagaacactggcaaaaagaatcacagctgatgccaaaacaccttatgaaaaagtcatcgccattcaaacttacttgcgctcagatccgcgcttcacctattcaaaaacagatgcacagcaaacaccggcaaatcgtgactatgttgattactttctgttcgattcacctattggttactgtgataatttttccagtgctatggttgtcctatgccgcagcattaacctgccagcacgatgggcaaaaggatttaatactggcacttttgaaggcggaagtggcgcgaacaaacaatacatcattcgcaatagcaatgcacactcttggccggaaatttatttcaacaatttaggctgggttcccttcgaaccaacaccaggattcagcaatccggccacccctgatgatcctgcaatgccttccgcggcaagcaatacagcctcacaatcagccagcagttcagcagtcagctcagcagtatcttcgtcagaatcgcgttccattgtgagcacctcatctactcaaccgaaaccgtcttctcgatcgtctctcggcagctttcattggacagctatcattgttttgactgtcgtcttgactttatgcattgtcttaatctggcaactaccagcgctggtggcgttcaccattagtttcaatttgacacagagaaactttccccgccgttatcgtttgttactttggtcattacggcgcgtgacacgacgccagtcaagtcaaccattgacagtctatgcacaccgcattgatacacgattaggcgatcaacgacacttcaccacgctcacgcatgcttacgaagcttggacttttggacatgtcgcaattcatcctgatccgctcacaacatccctaaaatccttgagcgcgcagcttgcccaatacgcacgacgcaaattccacgtgaaacaaaattaactttacgcaataatcgttccacatgaaacacagcagcatttctgctgtgttttttgagtgtttaacaaaaatactcggtttttacataccactaataccggtactatttccaaaaaagtttccttcacttcctagaaattctcgttaaattattcatccctattcattgtcataagcaccatctgaaggtttcacatgaaacataacacctattattcatgaaaatgtcacaattcattcttttccggctcgtctaccctgtgagaaccttgctataccaacatttagcagaaaatccttgcacttactaataaaaagcgagtatgataatacaaacagtttctgagtagaccttagaaattgtttggcccctgctgctattcttttagcagccgtgccttttcgactggactctgcagttagatcgtgacgtactcagaagaaaggggggagccgctgactttagcggcgaacacttatgaaagttatgatcgtacttgaaaacatcgtcatggacggtgttaaacgcgcatcaactgttttaggaaatgatctcgttaaacactatgatgtcagtttctatagtttagcagatgcccctgcatattttgaattggacgccccgctgcttattgccccgcgtccgacagatcccaagctgcttaacttctttgggagcgacccatatacacattatcgtgatcaaattaatgacttgattatgacgattcgtgaccagcattttcaggctgtgattttgcctgctggtttgacgaccagcttcgcaccgctcatcaagcaggcattaccagatgtcaatctgattggctggatgcacaataactacgcaacgtacatggaagattactacgttcaaatgcaagctgagtttgaaggcggcttgcaagctgttgataccttggtcaccctcactgaaagtgacctaaattcttacaagcgtttcaatccgaacacggttaaaatttacaatccactcacccttaaccccactggtgaggcaaatcttgacgcacaccggatcgccttcactgggcgcattgcgattgcccacaaaggtatcgacttcttactcgaagctgccgcatctttaccagatgactgggaaattgcgattgccggctccggcactgatgaagatatgaaaaatttctacgatttgattgactatttccatgtggccgacaagttaatctaccaaggcccactgaaagaccaagccttacgcgatcattatcgtaatgcttcaatctttgtatcgacctctcgttgggaaggtatgccgttagttatcggtgaagccatggcttctggcttacctatcgtagcaatggaaaatactggctcacgcgaatatcttggcaacaatgactacggtttactcacaaaggcacaagacgtccctgatttcgttgataatctcaaaaagatgatgtcacagccagcattacggcatcattatgcccatcaaagtctcgaacgtgccagtcactttagccccgaaaccattgtgagtcaatggatgccgattatcgaacatcaaccaacccgtgtttcagttactggttaaacaagccccgatgcaagcgcctgttgcatcggcttttttgtgagcgcgttatgatgatacacgcacaatcccgattaaaaatcggcccataacgactgtagtttggtcatgacagccaagattcggtacaatgagcttatcttaagtatggaggctctaaccaatatggaatcaatgaagcaaagaatgcttggtggcaaactgtataaagcaaacgatccagaaatcagcgttgagagtcagcgaggcagtgatctcgtctggcagtttaatcatttagcccctgataaaaaagcagaacgagctgcagttttaaaacaattatttcatgcatttggagacaataactacattgagcctcctttctacgttgactatggtgctcacacgtcaatcggtgatcatttttatgccaacacagattgtgttttcttggataccgcgccaattaccattggcaaccgggtttatttagcgcctaaagtgagtttatttacagccggccacccaattgatgccgctatccgcggtgaagatttagaatatggtaagcctatcaaaattggcgatgatgtctggattggcggcggcgtcattattaatccaggtgtgaccatcggcagcgatgttgttatcggttctggatcggtggtcacaaaagacgttcctgatcatgtcatcgttgctggcaatcctgctcgcatgattcggcggattactgataaagatcatgcccagtggcaacaacaaaaagatgagttcttaacctggcagcaacaggctgatgaaagccaacaatcaaagcagtcttaactgaccattaacggagagaacaatgttcaaattaatagcaacagacatggatggcacctttttgagagacgacatgacctatgatcgcgacctttttgcgacgttacatgaaaaaatgcaagcgcaaggcattcagtgggtggtggccagtggtaatcaatactttcagctgacttccttttttgaagctttccctgatacgatttatgttgctgaaaacggcgcctacattcgcgatgctaacaaagtatatgctttaagttcttttgaaaacggtgccattcaaccaattctgactaaactaactagcatacctgatctcaaaattcttgtctgtggtcaatcaagcgcctatgccctgaaaactactgatgctgcccatatcgcaacggcacgacaatactacaagcaattacgtttagttgacactttcgacaatctcgatgatcgcattttaaaatttgccattagttgtcctccagaaaaaaccgcggctattgttgccgaaatgcgccaactgttggttggcttgggagaaccgacaagcagcggccacggcgacattgatatcattcaacccgggatgaacaaagctgccggattggcaacacttggtcggcatttaaacattcaacttgctgacatgtgcgcttttggcgatggcggcaacgatttagaaatgctacgggaagttggtcttggtgtggcgatggcaaatgcaacgccagcagtactggcagtcgccgacacaaccactaagagcaatcaggaacaaggtgtcttgcagtttatgcatcatctgttatctgaaccctgaagtccttgttggaagaagccactaaaaaggaggccgcatgcatctcgattttgcgatgcatgcggcctctttttgtgttccacgtgaaactcactcgaatacgcggacgtttcacgtggaactaggcttaacaaatccctacttttcagcaattgataagtctggcactgtttcttgattcgtcatgaccattggcgaaaacaatcgcgcgatcatcgcggccgacagcttatgttccgagcgcaacaagtcaggaatagcaacgtgctgcttcatgctgtgctgaatcaatctagccgtcgcctcataaccaagatacgggcttaaaactgtggcactgatagccgaatggtgaaccgcggtttcacactgctcacgattaaccgtcagcccagccacacagtttgacgttaaggttgcaatgccgcgagccaagtaccgctccccttgcaacaaatcacggaaaataatcggctcaaaagcattcagttcaagctgtccggcttcggctgccatactgatcgtgacatcttggccaatcacctgaaaggcaatttgattaacgacttctggaatgacaggattgacctttcctggcataatcgatgaaccagcttgttttgctggtaaatgtaactcattaagtcccgcctgtgggccactgcttaacaagcgaagatcattggctacttttgacaagtcagtggcaagtcccttcatagcaccagagaaggccaccaaaacgtcgcagttctgcgttgcatcaataaaatcctcagctggcttcaattgcagatcaatcaattgattaacctgacgaataatatgactacggtaataaggcgacgcattcaacccagttccaatcgccgtaccgcctaagttaaccgcctgtaaatcggccgcagcccgtgtcaatcgggctaagtctcgacggaacaagctggcatacgcgtgaaaactgtgtccatatgttgtaggaacagcgtcttgcagttgcgtgcggcccactttaacaacatccgcaaactcatgtgctttagcgtccaaggttttgatcaaaaacgttaatgcttgtttcagcggtggcaatgcctgtaatgctgccatctttccggctgttggataagtatcattggtcgactggctctgattaacatcatcatttggatgaacgcgaatcgttttgagctcagcgctggccaagttggcgacgacttcattgacgttcatattcacggaagtcccagcgctaccttgaatcgcaggcgcgaccaacgcatcttgatgttcccccatcagcaagctgttgcacgcagcaacaatcgcccgcgactttcgaacatctaacgtacctgcagctgcattcacttgtgcagctgctttttttatgatgatcagacttttgaaaagtagcggatcagtccgctctgtactgatcgggaaattcgttagcgcacgggtcgtgtgaattccatataagacatcctcatcaattgccaacttaccaatacaatcttcctcgatacgcattgtgaacttcctttcatataccaatatttactttatcagtataatcgggtaaaagcgtgcgtcaacgtttgttgttaggtagtctgacaacgcctataaaaagtataccaatttaaaaaatcactgtgatgaagcttaaatgcgttaaacgtattcatttaacaggtaaccgtccgccgtcacgccattgtccgatcatttgctgtgcttgacaggcgttagcaaactttgtcagccgttgacgaaataatttaggctggtgacttttgatttgaatcgtgtcacaacggactcgttgatacaaaggcggacacgactgaaaatactgccacgcacccggacgacgtttaagtgctcgaataattctgggatcaaacttgaaatgacgcgggttcatatcaggcaaaacagcatacccagctgccgtcatcttccctaagtgaatcatgcggcgacatcgttctttattcaattccgaccacgcgctccccacttttcttggtacaaagcgctgcgatgctggttgatcaggtgccaactttttgtaggtactgtcgatccagccaaaacacatggcttcttccacggcgtcaacataccaaaacgtgtcatcctgttttggtacaccacgtttaacgtctacccaacattccgaggcgtcttgatagtgagctgttaaccaactacgaaattggtggcgatttgctaccgttagatgattgacgatttttctggtcaataaatccgcctcctcatatagcaactttctatggccattttacaaaaaaatctacgcgacgtattcatccgcgtagatttttcatctaatttattgatgctgaattgcccatcaatgtccctgatgtttttctaaacgtttcgcctgcttcttcaagcgaacctcacaagcgtgctggtctttcaattgcctgcgtcgttgctttttcacctgcaaatttcgcttgtgtgctagcttcaaaaaagttgttgcttgggtccttttagcgttacggacttcttttcgagcctgacgactacgcctttttggacttattgtcatctgtaacttggggagaataacatcctgtgcggctacccaatgtagatcttcccatcgttgttgaattaaatgtaacaactcacttgctgtcggggcttgtgtcccaaatgtgactttagcaacacgatacgtgtctcccattgtttgttcgaacaatccgcgataaaaaggtcgttcaaaataaactgttagcttgccttgaattgtcaaactaacacctcctttaagattttcacgcaatctggacatccaaggaggaaggatactgacagcctaagccgcgtctggactaccaaccagactgtgtttttgatagcgcaatgttattgtctgactttgataaaggtcctgtcaagccaagctagtgtatgacaatatcaatgtctcttaccaagtgcatataagtccgtttagcctcactactacataggtacttagtcagctgtggactgccttgtcagccatcgataagtcactacttccgtaaaaataagcagtagtatcccaataaccagaatgaatcctttcatagataccaattcatgtccagcatgtagcctcgtcatggtgacaaggccgcccaacaaaagcaaatgcacgggaaataatctccgatatttttttgaaagcttcatttttatgcaacaactcgtcagcttttaaaatttttgctgtcaccctataggaccgacatgccaagatttcgagtcatttcttcacctcctgcagcatctagtgtaacggacgacacgcatgataacgtcagaaaaaaataaacgttctgctttctatgattaacgtcaatattctaaaaacctccccactaagttgacccttgccaaccttgtcaggaggtttcaatattgcttttaagcttctgctgttgcttctgccgcgtgccggacactttccgccacgacttccgcaacatccccgtcaaaagcattaggaatgatgttggtggtcgatagctctgcatccggaatcaaacttgcgatgcccttcgccgcagcgatttgcatgtcaatggtgatcttgcgtgcgcgtgcatccaaagcgccacggaaaatgcctgggaaagcaagcacattattgatctgattagcaaagtcgctccgcccagtaccgacaatataagcacctgctgccaatgcctcatccgggaaaatttccggctctggattagccatcgcaaagataatcggcttgtcggccattgttttgatccattctggcttcaaaacatgtggcgcggatacccctacgaaaacatctgcaccttgcagcgcatcttccaaggtgccagtccgattttcatgattcgtgattttcgcaatggcggcatggtgtggcggtagttgatcggcattcttttcagctaagataccaaccttgtcgaccaccatgatatgcttaacgccagcggccaagaagcgccgggcaacagatagtccagcagaaccgccaccgttgacaacgaccctgatatcgccaatatcctttccagcgactttcagtgcattgtatagcgcggcaagaaccacaatggcagttccgtgctgatcgtcatggaataccggaatatctagctcctcgatcaatcgcgcctcaatttcaaagcaacgcggcgcactgatgtcctcaaggttaattccgccaaacgttggggccactgccttaactgctgcaataatctcttcagtatcttgcgtatcaagcacaatcggaattgaatcaacttttgcaaatcgcttgaacagcgcggccttgccttccatgactggcatagcagcttcagcaccgatgtttcccaagcctaataccgctgaaccgtcactgatgactgcaaccgtgtttttcttggtcgtcaggtcataaactaaagacttgtcttttgcaattgccgaggaaaccgcaccaactcccggtgtataagcaatactgagatcatcccgtgtctcaatcgggacctttgagacaacactgagtttgccgccaaattcttttgcctgatccagtgccagttgattaaaatctttcttttccatgattcttttcccccttgtttaaagtgcgctcccaagtcctgaaactggactggtccacgctccacctaaacgcgatcgctggccctgaaacctgcgtgtaaggaccttggtcgcaatggtcaaagcccgaccatctcgccctaggccacttactctctggtttctaaccgggccgactcacgctctatctaaacgcgatcgctggccctgaaacctgcgtgtaaggaccttggtcgcaatggtcaaagcccgaccatctcgccctaggccacttactctctggtttctaaccgggccgactcacgctctatctaattatgaaagcatccgtaaaatcgcggtcattgagataacagtgatggcaccacccaagcgtgttgcgacctgcgcaaatggcatgaggttcatgcggttcgccgtactcagaatcgccacgtcgccggtcccgcccatgccgctttgacaggctgtcacgatggccgtttcaatcggattcatattcaagaaccgagccacaaagaagccggttgaaacaaccgtcaacacaacactgatcacgacgataaaatattgccaacttagcataccaaccacatcttttagcggaatgtataagagaccaagtcccgccatcaatgggaaagtgaagttactggaaataaatttatacaattgcttagcgccacgttgcgtttctcctgggataacgttgagatatttcaaaattgcggcagcaacaatcatcagcactggtcctgggaagcctgtgatggactgaagcaacatgcccaagatgaataaagtacaggcggtcaagacgccagcgcccatcattttcaaatcaatttcgcctgtatcgtctttcatcgcatcggcgagatcatcttcggccccgtttaatcgaaccagctgcccttggcctgacaactctggccgtttttcccctaatcgattcaataaacctgaacacataatcgcgaaaaaatttccaataatcgtcgccggaataagctgagcgacaagcgcgccgctggtcgtgcctgtgatcgtgctgtatcctagagatagcggtaaaataccttcaccaataccgcctgccaatactggtgtgacgatgaagaacatcgtgtgtttccattccaaacccagtaatacgccaaccagtgtcccaacacccattgcaagaatcatgccgagcatcattggaataatcatccgcatcaatccttgaatcagaattttacggttcattcccaaaatactgccgcagacaagacaggcaatatagaaataaagaaagtttgcttgtttcatgagcatgtctgcagcttttaacacattcggattcatcgcattgtagaaaacgagaatcgaaggtaccaacagcgataaaatcgccggaccgccaaagttcttcacaatcggaatattggctccgatcgtacctaataaccaacccaacgtcagaatgaccgcaaacccgccgagcatgttaactggcagttgctgcatcacaccggcaaggacgatgaccgctgccatcacgatataaactggcaatggtaccgaccctaccttgaagtccatccactttttctgcggactcgttgatttgttgggtgtaaccgtcttgttctccatgtttccttacccccaatcttttgttacttacagcatattgtaagcgcttcatcaggggaagattatttaacttattaaaccataaacccatttatttaagcgattgttttactattcacaagatggtttctctactgaacaggagtatgatcatgaaaataaaaggatggcggctatggggctggctctcattaatttttacttccaccttgttattaacggttctaactgtttatggtttgaccatgctggaaaaccgtcagcaatttgaaagccgtgaaggtcaattgttgatctcaattggccgtcagttagcaaaggatccccgtgtaaccgccgcacttgaagcaaacaaggctgattcagccacgcgcacctacgcagggactgtcgagaaaaattttgatttagattttgttgtcatcatgaatatgcaaggcattcgcctgacgcatcccgatcccaaacaaatcaatcgacattttcaaggtggtgatgaagtgactgccttgcgcggtcatgagcatgtttcggttcggcgcggaaccttgggccgctcactgcgcggattcgtcccagtgtatcgccaaggcaaagagatcggtgttgtggcactaggcattaaggtcacctcactgcaaacactcatcaagacctcgcaagatggcttccggctggcgctattcgccggtacgatcatgggcctgctgacagcgtttttagtcgcctactatattaagcatcagcttcatgaccttgagcccaaagaaattgctaggctgcttgaagaacgcaatgcaatgcttgaagaaaccaaggatcctgtcattgtgattgatttgcaccaagtcatcatgctcatcaacaaagccgctgccaagctgcaaaatcaccttataaccgaaagcgcctttattggccagccattgacgaccttgattgccaaccctgaacgtgtcaatctgaatgtcaaaaccgagcagttttatcaacaggatggccaggattatcttttctctgccgcacctattatggtgaaaaaacaaaaaataggttacgttatctttctacgaaacgctactgaagcgatctttgtcgccgatcagttggccaacaccaccgcctatgccaacgcactgcaaagccagtcacatgaattcatgaataagctgcacgtgatttacggcttggtggcaataaaacaatatgacgaattggccatctacttgcaagatttgttaaaaccagagcaagaatttgcaaatcgcttggccttgctggtcaaaaatccactcgttgccggcttcatgattggtgaacgcgaaaagtttgccgagcgtaaaacgaccctcgactttgaaatttcccccgaactaccacccaatcctaatacccaagaaaccaaaacgctgttaacattaagccgctatctacatttcgggctactgcagcacgatttgccggacaccattttgatccagctagagtacgcacagaatcgtctcacgatcgtctatcatttagacgaaccagccaaacgaacggactttatctcgcttattcatcaagactacttccaacaactgctgacggagttgaacggctcagtcaccgttagctcaaccgatccgctgacactaacattaaccgtggactaccacgaggaggctcaaaatgacgaacatcctaatcgttgaagatgatccaatggtgcaatttatccaccgcaattatttagaaaaaatcggtacttttgacaccatctactcttcagaaaccatcgccgacgccaaaaaactcttagccagccgatccatccaacttgttttacttgatatccgcctcaaagacggcaacggcatcgattttttaaccgacctgcgccgcaccaaacaaaccgttgatgtgatcctcatcaccgcggcaaacgaggtcaacattgtcaatgatgccttgcacttaggcgtgattgactacctcatcaaaccattcacgttggaacgcttcgaaaaaagtattcaacgttacagaaccaagcatcaagcattggtaactgatcagcttaatcaaagtcaactcgacacgtatttcgaaccacaaacaaccatccctccgacagtcgatctagacaaaggcctgagcaaagccacgttgcaactcattcaaggcgccattaaacaactcccgcaaccatttaccgtcgcacaattaacgacagaaaccggtctctcgcatgtttctgtccggaaatatttaagttttctagaggatcatcattttctgaaaggcgatacgatttatcgcaagacaggccgaccttataaaacttatcagatggtcacggcaccacatgcgctgtcgtaaacatcattcaaatctttaaaaaggcagtgatcttaaatactaagatcactgcctttttgttattaatgattaaggttgcttacatacaatgaacgctgatactgtatttcctaaattagataagtttcacgtggaactcctcagaaaattaagacctacatttggttccacgtgaaactcgctgccactttccacaaaaaccggttcacacacccgttaaagatgtctgaaacagtccattggcaccgtttctcctattttttcgacgcttcaggcaaagccgtatttttgttcgtgatatcaataaactgtgcttcacctgctactgaatcaacggttttttgtagacgacgcatggcggcgcttgcaattggcaaatctacaaagtccttggtcgcattgtctagttcgacttcatcggctacggaatcttttagcggccgcggattgctttcatctaaagcgcggattacaactggcttcaatggacccatctggagcaagtcgagtgttgtttggtagtcaatatcataggcatcggctaagtcaagtgtctcacgaatgccggcctctgctgccatgatggcaacattcgtgatcaatttcagttttgcaccatttccctgctcaccgacatattttacagtgccaaacgttttcaagataggtgtaacatcagcaaccgcctgtttgtcgccagcggcaatcagaaccaagccagcttcacgtgcatacttcacgccaccaatcattggcacatctagtagatgggtcttggtcggcatgacggcttgaatcgcagtaatcttacgcgggtccaaagtcgaagtcacaatcagcgtactccccgtctgcaaataatgcacaatacccggagtttcagtggtcccaatatgaagtgctggcacatcgtctgacatgaccgatgtgataatgaccttggacgctgtcacagcatcttccagtgaagttgccgtgcgaacgtgatcgcccgctactgccgccatcttggcgggcactttatcccaaactgtgacgtcatagccagccttggccaaatgtggcaccatatgactgcccatatcgccaacaccaataaatgttattttcatgttcttcttccttcccgatcgaaaatattcacctaggcaatagatacttaaaaaacaagtatttttcttgaagaagcatttgatcaagaaattcattgccagctaaattcgattaaaacaggatcaataacacctgtaaccattaacttagcatgattaaaaatcgatttcaataacacagctcggcacgagtcattgtcgtcttttttccctccaccttacctgtttgatgccaacaaaaagtgttcctaatagggttacagtgctaattttttccatttacgaattttcggtcgaaaatttgtaaacggcgcaacactattgatgtgaatccacttccacaacggccattgcgccttggtcgtagcccacctccgaacgcctgcatcgaaaagctccgattgtgataacgtctcgatccaagtacacaactctttgaccagcagatcaagcgcagcaagttggtcttgaaggctttgttgaccatactgctcataaaaagattgatacaaaccacctaggttattccatttatagcccggtgcgggcgtttcaacctcaataccagcaacctcatcgcgatcccagctcagcaacaagttgagccaacccaattggtatgacagcatttctgacggtgtcttatcaaccccttcaaccagcaactcgcgcttttcttcggggatatcggtaaattccgccctaaatttcgcatagcgctcttcgatcgtgtccagcaaggcttgtttatcggcgtatgttttcaacttgatcagctcctttagctaaagcgtaccaagtcacgtcgaaggttgctactcttttaggataataagaagcctttcattctctttatcaaagagcaacaggcactgattcaagaaccttattctagtgcctttccagaaactcgtgtcaaactcaccgtcaacacattatcggccgttgtattgtaatcagccaacatgcccttcacgatccctcgcgatgggccatgcgtgctggtcgtttcctcgtaattttgaatccatgtgctgactgcattaaatccgaattcgaagccttcaaaaacctgcatgtaaaccgatgagcgtggatttgttgtcacaattgtgattttcaaaacccggccatcagcaatctgcatggttagcttgatcaacccatcatcgatgaaagtgacgtcgccatctgcggcagtctgcggaagtttatacgccgccagtcgcatgttttcgttataaacccgttgtacgtaatcgtaactgcccaaatctctttgcattcttattcaaaacctttctgttagaatatggctgatcatttggtgtttgcgaatgcacatcaacctttcaaattgacgtgtggtagcttccacagtgtaccgtttagtgccagaaataagaattaattagctcacccgttccttggctaacgactaaaacactcactaaagcaatgaaggaatgactacgatgcgaaaaccatccgggcgtcaccgcggtacgaacaaaaccttatcctttgcaagtgtcattctgcttgggatcaatggcatcattggatccggtatctttttgttgccaggcacactttatcaagaagctggcttgggtagtgtcagcgcgattgttttggctggactcagtacaacgttaattgcactgagttacgctatgctcgcctctaaaatagacgatgatggcggtgcgtgggtctattcaaatcgcgcttttggcgcttttgtcggctttcaaacaggttggtttggatggtttctgggcgtgattaccattgcggctgaattggccgcttttctcactgcattgggcggattaatacccgttgtcaagcaacgaagcgtctatattagcgtggccttagtgatcattgctgctttaatcgccattaatttagtcggaccaaatatcctcacgttcatcgataatatctccagtgccttgaagatcatcattctcatcgcggtgattgctgccggtggctatttcatcagtacacacggcctgcacgtaagccagccgcaagcagtttcatcagattttcgcacagctttctcgacagcattctatatgtttaccggcttttcattcctgccagttgccgcgaacaaaatgaaaaatccagaaaaaacactcccacgcgccctcatgatggtcatgttgatcgttattgccatctatggcatggctcaaatgacgacgatcgttattctcagcaccaatctgactgctgaaaccttaccagtcgcggcagcgttcgccgcagttgttggtaccatcggaaaaacggtggtgatattaggtatgctcatctccattctgggtgttgctgtcgccgtttctttcgatacgccaatcgaaatggcttcattagcaaccgaaaaaactttgctaccagcagtattcgggcgaaccaacaaaagtggtgccccatttgtcgctatctggttgacaatcggtattgccgcaatgctagtggtatctggcagctacctatttttagtcaacctgatcgtatttagtgcctttcttcaatacatcacgaccatcctagcatggttcaaattacggcatgatccaactctacccgctggtattcatctaccaatggcgccacttttaatgggatttgccttattgctgatcggctatctaatgaccagtgctacatggctgacttggctgattgccgtgatcgttgcattgatcggcagcgtcatctacgccaccgacacccgcagacgaggtgaatgacgcagcttgctggtttgtaaaagtcacaaaaataaccggctgaaagctctgccggttattttaacaacatgttgttatcgttaccgattaatggacctcgccattctctgtatggtgtgccgctcgccacggatcgccttgctgactgcgtataagttatcgacaggtgattcgaatccccatgcagaatcgcccacatgctgcatatcaacgccacagattttatttcgaatcgccatctcctgcaacacatgactgccgctgccttcttgactcgtgccaatcgcactcatcaccaaaccacccaagcgatgaacaactttcacaaccgccttcaagtcagcttcatcaaatcccggaattgatccaaccgccggcgccaaaatcacatctgcacctgcttcaataaactttttcgccgtctcttccgtcatgagcggttcgtcaacaccagaagcatgcattttccctgcaataattaggccggtaaaatacttcttggctaacgcaatactgcgaatggtcgcttcatttgtaacgccagtacccggattaccggtcagcaccatgaactgaaaacccatttcttcggcctttttgatgaccgcctcactggcagtgcatcctggcaaaatggcaatttgattttccatcattttgggattgtcgccaatcggttcaatattaattccaattggtcggccaaccagttttcgcagtctcgtgatgctctctttgccgtcatgctgaggcgcgctgtataaatctctttcaccaggatagaggccaaaaattttgggatcatcaacatcaaggcgattgcaaagaatcatatcagcgccaaatgctgcagcaatttcggctgtggtaatactgtccaaattctcttgcgtcacgatattctcactaacaataatccgcccttcgctagccttgatgctttccttaagctgctgcccatcaaacgtcatgacctcgcttgtactggcacttagtagtcgtttcaccattttgttcattgcctcctattggttgtcttttagttaatactagcaccttgcttattgaatcatgctacttctgctgctgcctcaatttcgtcctcatcaaacattgattcatcaacaccccagaaccaattaagaacaaatgaaactgctgttgttatcaataaccctatgaccgccaaaatgaaattattgccgcctgcaggattgataaactgcggcaagctcaggattgaaaccgttacgagtgagaataccttgacatgaaaaagtccgaagaacagaccaccaatgccggaagcaataatggatgggatgatcggtttcttcatttttagcatcaatccgtaaactgcaggctcggttatgcctgaggccgcaatagagaatgcggccgtggcggaaaacgtcttgacactgcgcttcttacctttaacaagaatagctaaggccatccccaattcggcaaaattccaaaccgcaaatgcgacccagagaaatggatcatagcccagccgtttaagattagaaatcgcaactgggaaaaagacccagtggctgcctgtgataatgaagaatccaatcaacagactaagcagcgtaataccaacaacgggcgcttcgtcatatacccaaagtgatccattagcaatgacactggctattccttgcccgattggtcccgtaactagcagtgttaatggtgccatcactaggaataccgggaacatcttgagtaatccaaacttattcattgcgggacgatcaacgactttttccagtagtgattgaacccaaacggtgatcaaaatcggaatcaaactggttgaatagtcaaccgctgctactggaagtccaaacaaatgaatgccgcctccagtactcaccatcttggcaaaatctggttgcatcatgatgcctgccagaatgagacttagaatcgtatctgttttgaaataccgtgatgcgccaaatgctaccaagaagggtaagaagtagaaaagtgaattacccatcaaataaagtaaccggtaagtctgacttccttgggtcacaagatgactcacagtcagcaaattcagcagtgcgagaaataaccccgccatggctaatccaccaatgaccggcgtcaacgagttagagattgcatcaagaatgccattcagcaatcgtttgaaggtgattttttcgcgcttcttattaactttttcagtcgttgcgttagcattcgatacaccactttcaccaacaaactgagcattaatatagtcaaagactttgtctaagtattctggcataacgatttgcaacttgccatcagaagaaaaggctttgacaaccccatcaattttattgattttatccgtcgtcacttttgaatcatctttaatgcgcacgcgcagtcgtgtatagcaacgtgcaacactttcgacgttatctagatggcccatactttcaatgagctgattaccaattttttcatatttttacatcattaagtctccctaccccatgtgcaatgctttctcaaccttcttcaaaaacatgatcatttgtagttcagttctccaatcatttctttagcagttacatttttagcggaaatttctggaaaagacttcaataaagccatatttgtgtagacaacggcaatcgtggtgtcgtgatctgagtcagcaaccaactttaaattcatattggccagtaagtctccggcctttactttttgattcctcgataccttgacatcaaatggcctgccatccatctcaaccgtatcgaatcccatgtgaacaagcacttcaagcccttgaacagtcttaattgaaatagcatgcttggtaggaaaaatcatggtgatattaccatctactggcgcatagatttcaccattcttgggctttattgcaaagccatcacccatcattttttgagccagaacaggatcagacacctcggttaaaggaatcaacaccccagtaaccgctgcatacacgtcctcttttttcttcttacctaatccgaacataacatacgctccttaactgtctgtccacacaacgaactgtagagaccgagccaacaagtactgataatttatgaacaaatgccattaaaaaaacacccatgataaatgatgaaattagagaactccaatttcattacatcttcagggtgttgccaacttaatgtcacaagccgttattcgatgatatgaatgatgtgaattaaaagaaatagccgatcagagtcatcaaattgatagccaacatggtcctcaatcaaagcgacgattctccctaaacttttgcccgcgttaggatattgcttcttcaactgacacagaagaaccgtatcgtcagtctcaacaagatcaacttttttaccgtcatgagtccttaacaaaaggtagtagaggtgtgtcgccatgcgcgaaactgccaaactactctccgaaaacttctcaccgtagtcttttcctaagatttcattgacgccggaaagaatatctaacgcctctgacacagattgtacagagctattcgtctctgtcagttcgtgttcaatgagatgcatggcaatgaatcccgcctcatcatccgaaaaggaaacatcactaaacgaactgatcaatgccagtgcttcttgaccgacttgaaactcttttggaaaaagcctgcggatatcaaatagcatcggattgctgacgactaacccgctcttaattctctgaaccgcaaagtagatatgatcggttaaaggaattaacaaatgaccatcaaattcaacgttgatgctcttttgtgcgaggctaatgattgaatccgttaactcaaaatacgatcgaggtatctcacgtgctaactccttaaatgagtctacccattgactatcatctcgggatacagggagaaagacatggtcatcctcggtcggaaaatactcctcatctcttttaaggcgaaagccaattcccttaccccaaattatctgttgcttgtcattcccgtcctctacaagcaaaacattattgtttagaacttgtaggattttcaagatatacaccttagctaggtcactagacgacatcaataaaactaaaagtaagcgcttactcaatgcttagtataatcaagttgcttttttgagtcaatacgttttaaataaaataaccaatcgtctgatctttaatcacatataaaagatagcttaaattgtatctttttggatacacataaatatatgttttgaaaaaattatttattaaattcttagttattaacgtgaaagtgcgtttaaactaacttcatgatgactgtcattacatttttatttcaaggtgccacaaaacttatccatctgagtattaggatgtaaataaaaacagcgacccacaagcatgtctatctgcctgtgggtcgctgttacgtttatattctgggtggtcaggggatcgaaccctggacccacggattaagagtccgttgctctgccagctgagctaaccacccatgctgcttatgtctgtcgcgcttcacgacttaaatataatatcatgtaccccttactggcgcaagtgttttgcaaatcttttttcaaagaatgtgacaaaaagctgactgctgcattgtgtcatcaagcggttaggcagcgatttcgtcggttactggcaatttgctgatggtcatttgacgagtggttgttcacgctcttatttcgtgataatgtgctcgcattcgccttgcatgtaaagaccttgaagtcgaatgaccaaaacttggccatttggcttcaaggccacttacgctccggtttaaatgcgctcctgctcgcgctcacaaaaaaagacggccatcgccgccttatttcactaacttattctagaacaaaacatgaatggattgattgctgttgatcagtttgatcgccttgccaagcattggaccgaccgagatctgatctaagccttcgaatttgtgcttaggatcgagcttaatggtatcagtgatgacgacccgcttgagtcccagatgcttgatgcgatcaacagcgccacgggagaatacgccgtgggtggctgccgcgtagacatcaagtgcacctgcttcactcagggctttgtaagagtccacgatgcgatcgccggtatcgattaggtcatcaatcacgatggcgtgcatgccggcaacgtccccgataaccccgatgtgctcttgatcgcgcttatcaacaatagcaattggcgtatgtaattcttcagccaatgcccgcgcttgtttggtaccactgtgatcaggcgcgatgacaacgacattatcgccaagatctagcttcttgaagtaatcgccgatcaagtggtgggccttgagatggtcaactgggatatcgaaaaagccttgaatctgatccgcatgaagttcaacagcaatgatccgattaacgccatccatctccagcatgttagcaacaagtttggctgtgattggctcacgggagcgcgccttgcgatcagcccgtgcgtagccataataaggaatcacgacattaatatggtgagcactcgcccgccgcaacgcatcaaccatgatcataagttccatgaagttctcattaaccggatcagagaccgactggatcacatatacatcagcgccacgaacactttccggtagttcaatttgaacttccccatcagcaaaatgattcactcgagctggcgacagcggtagcccgacctcttccgcaatcttttcagctaatggccggttcccattaagactgaataattttaattcgtgcatcgatttctccctttttcgtatttaacggtctgcaccgtcattatacgagaaaaggcaagaaattgcgactgattatccaatgcggtaaagtaatatcataacatttgcagattcataagcagcgctccagcaggcggcaccccggtctccgccgtgctttgccctgactgcaagacttggaaatgggaggcactgagtcatgaaacaaagccatttgatcggccttgcaaccccactgttattatcggctggcacgttagcgaccgccgaaagcttttatcaatatgcatttcgccgcattaactatattccagacgcgcggcgttcgatgcaaaagtatgcggcttcatattatcgccatgtccactgggtagaaagtcaggccaatattgaggcatggcatatgacagccccggataatcaacgacttgaagctctttggttgccgcatcccggcagtaaaaaagcggtgattgtgggccacggttacaaaggtactgggattacgatgagcaactttgcccacatgttttacgatctaggcttcaatgtcctgctaccggatgatcgcgggcatggtgaatcggatggccaatacattagtttcggctggctggatcggctggattatttgggttggctgcaacgtatcattgatcgaatcggtgcagacagtcaactgctgttgtttggtaccagcatgggtggtgccacagtttcgttggtggcaggcgaacccagtttgcccaaacaagtgaaggctgtcattgaagactgcggctacactgatgttgaaaccgaattggcctacttactgaaaaagcagtttcacctgccaccaatgccgttggtgccactggcaagttttcttaactatcgccggttaggttatcctttacgcgttgtcaacgtccgccaagcactcacccgcaaccatttgccactattggttattcacggtgcggaagatgtctatgtgccaacgaaaatgggtcggcaaaattatgcggcttctgcgggtcctaaagccctctggatcgttccgggcgctgcgcacgcggaaagctactggatcaacccggaagcttatcaggcacacgtcaaacgttttctagatatctttttctaactgttgctttgtaaccatcacaaaaatggatcgtctgaatgatcaccaccattcaaacggtccattttaatgtctaatcaaaaacgcgcagcacagtctagaggtcatcctcatcatctgcttcagcctcatcgcgttgtttacttagcgcgtcgaattgacgcaacatggccaaatttgtctcgatactttccggccattcccaatgctgaacattaaaaacgtgcttgaggtgcggaccggcgctggctggccacaatttggtcgtataggtcaccttatcggcagcaaacacttctagcaaagcctgactttgcaaatagaagctgtcattttggccgccaatcagcatgaatggcggcaacttgaggtctttggcaacttgagaaaagttaaggtggtcagccaatgcagcatcgccaccgctcagcttatcaagataaaaagcggccatatcgctcatatcaccagcggcttctggcagtttgccaggttcagcgactgggcacaccaaggccaccaaagtgaaattgaaattaactcgatcaacgccaaaaagttcttgcagctcttcgctttgctgaatgcaggccactagtgacgctagatggccgcctgccgagtcaccggtcaatagaacatgatcgagatcaaagccgcgctgtggaccaaaatgcgacaaccaacgtaagctagcaaagatgtcttgaatctgcccgcgcacatcgacatctggcagcaagcgataccccatgcccatcaccgcataaccttgactcgccaaatagcggcaataatttcggttgagattgcgatcgccataaaaccaaccgccgccatgaacatcaatcacagttggcaacgtcgcattgcggcgttttgccggataatataagttcaaggtctgcttcgggtcagcagagttttcataccggtattccgtttcccagtggacatcctctggcacccgttcatccgcataccgcgccttatcgcgcgctgccgtctgcgcccagcctgcctgaatttttgctaaaatgtcatcatctgccattaccaaggcctccatttcaccatgttcaaatcgcattaaaagattaatcccatcttaacgcaaaaagactgccagtgagtcaactgacagtctaatcgtatgaattaaccttatctattaacgatctttggacttaacgctagcttcgacttcatcaatcaagccagcatctttcaaaccggtcacttctttgataacatccaccagcggctgatccttcagcatcgcttgcaacttcacagcttcggcatcattaggttcaacataatggaacatcatgccaacggtgtccatcaaaacgctgtaattcaaaccgcgttccttcaattcgcgaattgggcgaataaagcgttcgtcgtaacctagtttgcggattggtgtccgggcaactcgagaaatatcatctgagatgtacggattctggaaacgttgcaacacccgattttgatagttttcgaggtctttttcgtcaaaattcttgaactctgacaacaacaacgaacgggtttcggccagcgcaccctttgcctgattgaagactttaggatccttgatggcatcgccaattgtcgtgtagccaaggtacttgccggtgtaagccgtggtagcgtgaccagtgttgacggagaagagtttccgttcgatataaggttccaggtcgggcacatagtctacagtcttgagtttcagatccttgttcttcatctgactctcgtcaacaacccattccttgaaatcttcaacactaacggccaagggatcatcgtgcttttgttgtggcacgattcgatcaaccgcggcgttagggaagccaacgtacgtatcagcaaaggtcttgccggcgtcatcgagatgctcgtagacactcttcttaagtgactgagagccaccgatcatattttcacatgcaatcacatctaatgcctgatgattgttggctgcatcacgtgcctgcaagccttgggcaattagcggtgcaatgattggcagaatctttggaccaatggcggtggtcaccagatcagcctgcgcaattgccttcacaactgcctcgggatccttggcattgttcaacccgtcaacattgtccacatgaatcttcttctcaccgggcgctgctaaggtgatcgtatattcgccgcgttggtttaacgcattgatgatcgtctcgttaacatcgacaaaattgattttgaaaccgttagcggcaagtgtttcaccgataaatccgcgaccaatattacctgcaccaaaatgtactgcttccatcataatttattcaacttccttcagtaaattgacgatttcctccggcgtttgggcgtcggcaagtttctgaacattttcaacatcactgcaataaagcgcaatttgcgacaacaatttgagatgttcgccatttaagccagcaatcccaaaaacaaccgtgaccaagttctcatcagccggatcatccgaccagtcaacaccccatggatattgcacaatcgaaatagccgtcgacttaatatatttcatcccggcctcagtgccgtggggaatagcaatgaagttacccatatacacagaaacatcgcgattccgatcaagcatcgaatcaatataagctggttcgacattaccattgtcgaccaagagttggccggcctgacgaatggcttcttccttggtctttgcttcctgaccaagtttgatcgttttaacgtctagtcctttcatcatgtcaccttcgatcaatttttttgatttcattcataaatacttctgtgatgatttgatacaactggctataatgccctttttcaaaaagttgtaaattcgttgttgacgcaatcagctttgcgctgacagcgctcaatagcgttagtgtttcctgagcaactgggttcggtgtcaaaagtagcaatacccgatgcaacatgatcgtgcccatatccatggctggaagcgacagcggcgtttttaaatcgaatgcgccgatgtaaggcactgtcacaccttggctactggtatgaatcatggcgagtccggtatcgggaatcccaactggcgctaattctagtcgctttagcaaggcgtctttgacgaccggcgcttctgccaccacgtctggtaaatgtgctagcatggcatcgattgtggctcctgaggttgtcaccgcttcggtgatctctgtcacagcgaagtgctgtaacatgtcatcagctgctaataccatggttttgagactttcaaacgccgtcacagtctggtctaatgacggttgtctttgctgggtcgcttctttcggcttgacctgttgcaataaccgtctgatttcactaatctcatcacgcgccaagattggcgtgatgacaagatactgatgcttgaatcccggcaatggcatcgtcgcaagaatcaaaccataatgtgccagattctggttcggcagatcactaacctgaatgatcttgatctctcgaatttccggcacctgtacacgtagcttcccagcaatcagactgccggtccccgggccatcgctcgtaatcagcaagacagctgctggcacttcggtgtgggtatggtccaagactgaagcaaagtacaacaccagatacccgagcgcatttccagtaaaggcaccgcgaccaaaaacatcgtcagccgcttgttgaactgcgtggtaaagttcaggataatcgtcgcgcagatgagccagcactggattcgtcatcgtgacgcctggcagccaatcaccgccagcggttcgttggacatgagccaacagcgatgagtaaagctgcgtattcccggaaaatttcccgggaaatgatctggcaacttcacgaatcaattcctgcacttcaaggttaaccgttaaatcaaacggatcaactggttctccagccaagccaccgcgaatggtactgagctcaacggcaagaaactgataatcgccaacgcggactttctggcgaatcgcggaatccatctccgccagaaactcgagagccaattgttggtcctggaaaagccgttcctgatcgaaatggcgttgcgcttcaacatgctgatcttctcgcaatcggcgggtattaactgctactgtcagtaacaccgctttgcgctggttgtcgctgagatccgccaacgccttgatgcgcagcaaagcagcgtttgctgccagtaactcttcctgcggtaatcgttcaacaaaataatgtgtgactggatcgaatgtctgctgaggatcacggagaaagcggaagaaaacgtacggattaatctcagcattcaacacgcctaccaatactcggcgaatatcgccttccgcaccatcaatccagataccggcagctttttggcgatttaattgcagatgatattcattcaaagcgggttcaagaatatccagatcttgcttaatggtggtgacactcacgtcaaccgctgacgctaacgccgtcattgtttccggaccgttggcattcagcaaccgtaatgttaaagcactttgtcgttggctaggatcaaatgtcaccacctgatcctgttttgccaaagtcgcggttaaggtagccaaatcattggtatccccgaccaaccgatacgtgctgccagtgcctttatcgagttttaaaccgattgtggcgatgtcactttccaattgcgaaagctcacggtaaatggtccgacggctgacacccagctgccgttccagctcatctcggctaacaccggcgggctgactcatcatgagtctgatcatttcctgttcacgattcgttagtaacatatttttcgcctcaagcggccgcaacaccgaccgaacttatttcatcttctcaataagcttatcatagttcgttgcgttcaagaggccatcaacggtgtagacctgaacattggcaaactgcaatttaacgcgacgtgctgtttctttcgaagcaataatcagcacattgtccttgtcatcaatctcgccgattgcgacattacgaactttcacgtctttattcagtttccgtaattcagcacggaatgtcgcctgtgccatggttgcggaaccaatgttttgatcatgatgcaggaagtcaacttcggtaatcttatcgagatcaagttcctttaattcgtcttccggtgtttcttgtttagctttagacgtctcagttgctggcattgcctcgtcagtaccgccaactgcttcagccttcaagcttgcgatgatttcatcatacttcggactgttcaggaaattatcaaccgcaatatgagcggcatcaggtgtcttgtccttagcccgatcagctaattcttcttgtgtcacaaccagcagtcctggcttgtcttgcaggttactgattgctgtgttggtaaccgaaagatccagacctgccttctttaccttgtcgcgcaagatggaagcgcccatggcactggaacccatgccggcatcgcaagcaaagataatctgcttaatgcccttggcggctgacatcacatccttagctgccgcaacattttgctgacccttagcttcagccttcatggacttcattttggcttcgctttcggctaattcgtcaccgcttgcgctcttatcgcggcgtaaaatgacagccgagatcaggaaagaaacaagtgtagcacctgtgacaccaacaattaaaccaatataattcccaatgttaaccggtgacattgcgaataatgcgaagatagaacctggagatggtgagctcttcaaaccaacattgaagatggagaaaagtgtcgtcccagtaacaccaccagccataacagacaggaacagtgctggcttcatcaaaacatatgggaaatagatttcgtgaatcccgccaaggaagtgaatgatgatggcggaaggtgcggaacctttagcagatcccttaccaaacagcgcaaatgctaacaaaacaccaaggcctggacctggatcaggttccagtaagaacaggattgacttaccatgttcggctgccgcctgaatcccaagcggtgtcaaaatcccctgattgatcgcattatttaggaacaaaatctttgcgggttcaataaagacgtttgctacccacaacaacccgtgattgataatccaatcaaccccagttgccatgccgttagtcaacgtagagataatcggacccattaggaagaagccaacgattgctagcaacatcccaataatgccggcactaaagttgttgaccaacatttcaaaaccttgtttgatcttatcttgaaaacggtcgtcccacttcttaatacaccagccaccaagtggacccatcaccattgcgccaataaacattggcacattagtaccgacgatgacccccatggcggcaatcgcaccaacaacgccgccacgatgacctgccaccatcgaaccgccagaaaaagcgatcagtaatggtaacagataagttaccattggcgaaatcatttttgcgagctgagcgtttggataccaaccacctttaaggaagatggctgtaataagaccccaagcaataaaggcaccgatgtttggcaacaccatgccagaaagcttagtcccgaatgattgcataccggctttcagattaaatttctttttttctgttgccggcgtgtttgctgtttttgcacccaaggcaaacacactcctttcccttatttacaagtattattgtaaccgcttcatgtaatcgctgacaaaagcttctttggcacagttatctgtgccaaacattcaggttgaatccccagctaacagtttactaaggaaagcatctggtttaaaaccataacagtgtacgttaactgtttcacaagttatggaaaacgctaccgctgtctacttttttgctcgcatcatactgaggacgctgttatctgatgttgttacctactatatgtcagttgtgcctgacgccctatcgactcagcataaacacagaaaatcaaaattttcgacatcacggtatagaccactattgacatagaggttttttgatgctacattggactagaccagatagggggatatcaatgatggatgtaaaaatttttgataacgatacagaagcaggcaagtacgcatttgatttgatcaagcaaggtatggataacggtgccaaagtgctcggcttggctaccggcagcacaccagtcaccatgtacaaagcaatggttaatagtgatgttgatttcagcaacatgacttccattaacttggatgaatatgttgggttggctccagacaatgaccagagctaccgttacttcatgcagagtaacctcttcgacaaaaagccattcaaggaaacctttgttccaaacggcttggctaaggatcctgaagaagaaaccacgcgttacaacaaagtaatcgccgaccatccgatcgacatccaagtacttggcattggccgtaacggtcacattggcttcaacgaacccggttcaccatttgacgcagaaacccgcaaagtaccgctgacccaaagcaccattgacgctaacgcccggttctttgcaagtgaagatgacgtacctcgctacgcctactccatggggatcggctcaatcttgaagagcaagaagattttgctgttagcctttggcgaaaacaaggcagatgctgtcaaaaaaatgattgaaggccctgtcaccaacgatgtgccagcctccgcactgcaaaagcattcagatgttgttgtcatcttggacaaagcagctgcaagcaagctgagcaagaaataagctatttctttcaatcagctgagatgaaacaggccgatgctcatcggcctgtttttttatggaagtgtggctaacccatttagaaaacggcgtgtaagcagccttggctgtgatgaccgggttttggtcataacccccttgcaagcaggtttccgagctgacaagcgtgtgaatccctttcaccccagtagtatccgttttttctgtaagcgtttcgatttcttgccctctgccgtacgtattccatggtagaatgaggccatcacaacatttagtaacggaggaaattatgtacaaagctgttgttttttttgatttagatcaaacgctgctcaatgatgacaaacaggtgccacccgaaaatgttgctgcgctcaaagcccttgaagccaaccagattctgccggtcattgcgactggcagaaattactacgaactggctgacattatggcagcaactggggtccgcagtgcaattgctgctaatggtggtgacatttttcttgacggcgatcacatttttcaaagtgtgattggcgagccgcaactcacccgttttctcaatacgagtgcagcacaagacattcaagttgccatgtacaacagtgaagcatcggcgctgaccggccataatcagctcacaaccgataactatgcgcaggtgcggcaaacaccaccgccggtcaagccatctttctacgagcatgaagcaatctgtatgatgttaatgtttgtaccatggaccgatgcaggtgaccagattgggaaacaattcatccaagatttcccagaaatgacgttctaccgcaactcgcattatacgtttgatgttgtcaatcatggcatttccaaaggcagtggtatggccatcctgttaaatcagccatccttacgtggtctgccaacttacgcatttggcgacggttataatgacattccgttgttgcaagcagctgacaccggaattgcgatggggaacgcttatccaaaagttgcggctgttgcggattatcaaacggacgattatcgcgaaaacggtattccaaatgcacttgcacattttaacttgatttaatttttaatgcgtaaaaacacatcaatattagcctattggtgtgctttttttatggcgcttatccagcagcattttccgctaaatttcggttgactttgcaaacgtatgttcccataataataagtgtgaactgtgaacttaaaaatttaattttaggtgcaaaaacactgtcatattaaggtttgtaacacttgctataccgtgttggccaattaaagtcaagaccgcggcagcgcaaattttctgctatactcaaagcatgctgtgcgttatttgggcgtggtcgaaacaccgatcaataatcgtacaacagcgcaaaatctgctgatggaggggtctctcatgttagaacaatcgacaatgcatccggtggtttggatcaatcaacatacttatatcagtatcgtcaaaaatgcggattataatttagaagtctgggagattaccgacgaaaatcggcagcatcggatggctcggatgaattacaaatatcaccgtgataactttgccggattcatctatcgactcttcccacagatcgacttgattcaaattcacaacattcaaaagaagatcaacccgtatttcgacttagaggtttagaggtgtacacatggatagtctggttattcagcttctgatcatggtcgttgttgctttgctggtaacactgctcgtcatttttgcagaatggcgcgctaaaaattttaaaccttggcaactcggtgttcaatcggttgtcgccgtggtcttactgggcgttggtattagcctgctaacagttagatgaggcaacttggtaaaacagccaagtctgttctgaggctggcacacttgagctttcaacatgttgcaggatttaaaaaaattattattcactatatagttggtcgctttgcgttataaagcggccttttcgtttggttccacgtggaacaaaaggccttcttctcgtctaatatgacccaacaaccgcaatataatggattttatttttggcatcggatgattggccttcgcagttgataccattgatcactacttttcttcaaaattaaatgacttggctgatgtcctccctctttatgcaacaccctttagcaaataaaacgcgcaaaatacagcattcgaattccttgaagacgacccaagatgttaaaattcaacatcgcatttgtcgcaaaattgaccattttgatgtattagaatccgaatacccgcgaattgaagcaattttaagcctgtcaaaataagaacacttttccgccaaatagcgtttttattaatggacgtcatccaattctatccgtatacttgcaccaacaaagcgattagggaagcactttcaggaggggcaagtatgaataaaggacgatcaaagggtaaacgtatttcgcaacgcatggtgatcattgggattggtgcattagccatgattggcgtcaccgtttttttcctagtcacatccaaaaaaccgacatcatcacccgcaccgacaacgatagccaccttccaagtgaagaagcatgagttacgagtgccaggacaggtacaggccgtacgtacgcaaaaaatcgacattcctgaaggcaccgtccaaaacatgacggttaaaaatggcgatagtgtgacgcttgatcaacaacttttgacggtttacaagcctgacgtacaagcaaaaattgatgaagcttcacgtgcgcttgaaaaacaacaacgcagtcaagccacacttgatcagcaaatcagccaaatcaaagctactttaagtaagaccgccgccgatgatccacagaagtccgccttgcagacacaacttgatgaggcgcagaataatcgccaagattcggctgatgccatcacccaatcgcatcaggatatcgctaaattaaagcaaagtctgaatacggtggttaaggctccctttgcaggtcggctgtacattgactatcaagcaaatggcagtcagaccatcacggaaacctcggctgaagttgaagccgttggtgaggtctccgaatttgattattcaagtgttaaaatcggtcaatctgcaaccgtacaggcgctggcaagcaaaacaaagcaagcgacagacatcaattttattagcagtgatccggctaaatccagcaagccgaatctcgccaagtatgaactcacaacgaaattacgtgacggctttttaaacggccaatccatcaccatcacgattcccctaagcggtttgttaattcccaaagaagcggttaaggacggggccgttttcaaaatcgtcaataaacgcgccatccgaactaaagtaacctatgtggcaaaagacgatatgtatgaagtctcagatggcctcagcagcggcgaccgcattcttcaaaaacccgacaaaacaatcaaagacggggcgaaggtgaacgttgatgattgatttacggcatgtcaacaaaagctatctgcaaggcgacacagccttcccagtgcttaaagatatcaacttacacattgatgaaggcgagttcgtcgcaattatgggcccgtctggctctggcaaaaccacattaatcaatattattggcttccttgatacagcttttgagggcgactacctttttcaaaacgaaaatgtcgccgcctttaatcgcgccactgcgtcaaaaatgcgaaatcagcatgtcggctttgtctttcaaaatttcagcctgatcaataacttgaacatttttgaaaatgtccttattcctctgagttatggtggcaatcgacgaagtgatgttaaaaacaaaatcactgagttgctgcattctgttggcctagtcgatgttgaaacgaaattaccgcgcaatttatctggcggccagcagcagcgggtggcaatcgctcgtgcccttgcaaattcgccgcaattcttaattgccgatgaaccgaccggcgccttagacagccatacttcggcagagatcatgcgactctttaaaacactccatcaacaaggcgtgaccatcattatggtgacgcatgatgaacacgtggcgctacaaagtgatcgcatgattaaagtattagacgggcagatcatcagtgatacggaggttagccatgcgaataactgaattaattcgaatttccttccgtgcgctaactgctaacaaacgccgcagcctcctaaccatgcttggcattgtcatcggtatcacttctgttgtaaccatcatggcactcggtaacggtatcaaagctgccacactcaaaaatttgcaaactgaccaatctggccaacaaacggctgaaatcaccttccttcctgaaagtagcagtgcctccactgctggttttaaggaagatgatgtggatctcgcctatcaaaccgctccagacaaaatcaaaaaagtgactatcaaacatgaaaaagagcgcctacaactgaatggtcagttagccaatcaagataggatgctatctgccacacttgttacatccatgcctaaagtgcaacttgcagctggaaacaaattaactaccgattccttacaaacagacggtcatgatgtccttttatccaagaagttagctaaaaaagtctttcatggcaacgcagcagcactgacatcatccatttttatcgggaagcgaagctacaacattgttggtattttcaacacgcctaaagagtcctattcagctttagatgttgacgttttaattcctgaaaaggcttataccgctggccagttaaacccaggagggcaaaaattggctatcaccttccaacgtggcagtgacatttcccagttggcaaacgccatcgttcgtcagttgaagaaatttggtactgaacgccgcaatggctcgtaccaatattttgattatgatgaattactaaaaggcatcggtaatgtgatcagcggtttaacgttgttcgtcggggccattgcgggtatttcgctactgatcgcaggtgtcggtgtcatgaacatgatgtacatttccgcctccgaacgttcacaggaaattggcatcagaatggccgttggcgctaccccagcagaaattatgaaacagtttctgttagagtcagtcatgctgacattaaccggcggcgttgtgggtcttgttctcggtggcttgattgcctggatgatcacagcgttcttgccatttaaacccgtcataacgcttggttccatcatcggcacctttgcaatttccagcattgtcggcattgtttttggcatcctgccagctaaaagtgctgccaataagaacctgatcgatattctgaaatcataaaaatgctcccatctaagtggcagcatgcagctttctagttctacattgaaagttcttgaaccaacgaaaaaacggttagatctgcgagatctaaccgttttttatacgctattactgctactgcttttagccaaaagccgtcattgctgaagacatcattccgagcgcttcttattgcgaacccctgctaacccaaacaagctcgctatgctagtcaagatcagcccaacaatagacaaatcattcgccgatctatcacctgtttgcggtagctgatgagtcgttttcacaggtgtttgctgattaattgactgactaggtcgaccagtaacactcggcactttgcctgtctcatgaccagtactcgtaccggtatttgtgccagtgccggtatctgtaccagtacctgtatcaggaagcggccctgatttcgcaacgatttcaaagaccgcttgctgggtatcgacattttcaagcagataatttggcagcaacgcttggatacgcttgaggccgcctgcgctaagtgtcacggcgtaacgaccaacaacaattggggcaataccatcagcaaaagccaagtcactgtcttcaagtatgatgtgactaccatccgtaaaaatcaattcgaaatgttgagcattcagttctccaggttggccatcacagattttttgctgcatgccgctgagctgtcctgacaaaaccgcgggtgtgatcgtaatggtaccattcattgttgtgtcgttaatttgataattaggaccaagtgcaaccatcactttagcaatgccactagcacttaatcgatacgtgtaggtgccaacattaacgctatcattggcaacatctatatctgcattcgttaaggcgactgtttgtgcaccagttggtagttgaactgttaccagtaatccactagcttggcttgctcgggtaaccccgtcatactggaaatgaccattattaacggtggccacgactgtcagtggcgtgatggtgatcgtgccggtcaatgcgttcaaatcggtttcattaagtgcatagttggtgccggctgctgctttcaacttcgctattcctgaatgactaagatgataatgatacgtgccagttgtcgtgttatcgccgtcaacaacaatgtcctgcgtcgtcaatgcaacagttagcctagcagtcccgcgtgagaggtaaacgacgccattgagacctgacgcttcacttgcctttgtacgaccatcataaacaaatgtcgtatcatttaccgttgcagttccttcagctggagtgatcgtaataatacccattaatgctgctagatcatctgctttcaattgataatttggtccagctacttgttgaagtttcgtgatggcgtcagtacttagccggtagtggtaactgccaacattgacaccatcatcagcaaccacgatatctgaagcgtctaacttaattgatgttgtatcgtcgccaagttcaaccactgctgttaacccttgagcctgactcgcctttgtttggccatcatacataaatgaaccatcattcgaatcagcggttgttgttgccggtgtaatgttaatgttgcccgtcaattttgctaattctgaaactgttaactgatagttgctgccgactgcctgttgtagttttgctataccggtggcggtcagcgtgtactggtaactcccaacattcacaccatcattggcaacaacaaagtcggctggcgtcaaggttactggcaccgtctcattgccaactgtgacgtttgcagtcaagccttgtgcctgacttgccttcgtcttcccatcataaacaaacgatgtgtcactgagatttacggcaccttcagctggcgtaatcgtgattgtaccgatcaattttgccagctcagaagcatttagctgataattgctgccggctgactgttgtagctttgcgataccaatgtttgtaaggctgtactgataacttccaacattcacaccatcattggcaacaacaaagtcggctggcgtcaaggttactggcaccgttgcactgccaactgtgacgtttgcagtcaagccttgtgcctgacttgccttcgtcttcccatcataaacaaacgaagtattggtcagagttgcggtgcttgctgcaggcgtaattgtgattgtaccagtcagttttgctaagtcgtcagcgtttagctgataattgctgccgactgcctgttgtagttttgcaataccggtggcggtcagcgtgtattggtaactcccaacattcacactgtcattgccaacagcaatgccggcggacgtcaagggtaccggcaccgttgcactgccaactgtgacgtttgcagtcaaaccttgtgcctgaccggctttcgtcttcccatcataaacaaacgaggcattgttcacatcagcagtactcttagctggcgtaattgtgattgtaccagtcaattttgctaagtcgtcagcgtttagctgataattgctgccggccgcctgttgtagttttgcaataccggtggcggtcagcgtgtactggtaactcccaacattcacaccatcattgaccacttgaatatcagtagacgttaagtcgactggcttggccattgagccaagtgtgatagttgcttgcagacccttagcctgacttgctttgctctttccatcaaagacaaacgaggcattgttcacatcagcagtactcttagccggcgtaattgtgattgtaccagtcaattttgctaagtcgtcagcgtttagctgataattgctgccagccgcctgttgtagttttgcaataccggtggcggtcagcgtgtactggtaactcccaacattcacaccgtcattgccaacaacaaagtcggctggcgccaagattactggcaccgttgcactgccaactgtgacgtttgcagtcaagccttgtgcctgaccggctttcgtcttcccatcataaacaaacgatgtgtcactgagatttacggcaccttcagctggcgtaatcgtgattgtaccaatcaattttgccagctcagaagcatttagctgatagttgctgccggctgcctgttgtagttttgcaataccggtggcggtcagcgtgtactggtaattcccaacattcacaccgtcattggcaacagcaatgtcggcggacgtcacggtcaccggcaccgtctcattgccaactgtgacgtttgcagtcaagccttgtgcctgaccggctttcgtctggccatcataaacaaacgaagtattggtcagagttgctctgcttgctgcaggcgtaatcgtgatcgtaccagtcagttttgctaagtcgtcagcgtttagctgataattgctaccgactgcctgttgtagctttgcgataccagtgtttgtaaggctgtactgataatttccaacattcacaccatcattgccaacagcaatgtcggcggacgtcaagatcaccggcaccgtgacattgccaattgtgacatcgccggtcaaaccttgtgcctgacttgccttcgtcttcccatcataaataaatgagtcatcacgcaactccgcagtgccttgtgctggtgcaatcgtaatcgtgcctgttaagctgcccagcaagtcacttggcaactgataattggcattcaacgcctgctcgactttcgctacaccactctgactcagttgatattgataatcaccaacattgacgctgtccgatcccaccacaatatcagtcgagctaagatcaacaactgtcgtgccagaaccggccgttaatgttaactgcaatcctgaagcctgactagcaatcgttttgccatcatatacaaattgtgtcccattaacagttgcagttgcagtagcaggtgtgatcgtgataacccctgggtgagtattgatatctgtctgatcaatcgtgacttcatcacccaaaatcgcttgaatacgtgtcaatccactaccattaagaagatatcgatacgtccctacatctggtgagtctgcttcaacaagtgaaatatctgtcgaagtcaaatcaatggcttgctgtgagccatcactcaaagtcacattaagaaccagttttggcgcctgactggccaatgtcatgccatcataagtgaacccactattattcaactgacctgtagctgtgagaccgatgataagttgtgccgtactcgtaccggtaaaattatagttagccgctgactcaccagcatcatttgtcaattcagcaatccgcgcccatgccgcctttgaaagttcaacacggtagacacccgttttcgccaatgcatcagcagcaatctggttgccagatgcatcaaaaaaattaaggtcactcagttgtaaagcaccagcattgaagccattcccaagactcagagaaaaggccgtcagatccaccgtaatcggttgacccgtcgcagttgccgtttgagtaccagtcaacgaatatgacgccgccagccgttgattataaaaaattttagctgagccactttcagccccatacgcgtaagtgactgtataccaagtcacctgatcactaggcacactgcctgtgacaacaccgtctctatctttagaggcgatcacagccccgttctggtccgttacagtccaagtcaaatcgctaagtggtatctcaatgatctcagtgccattctttttcacggcgccgccaaagttcagttctggtttccaaacctgacccgtgaaaaggttaatgtcatgggcatggataacggggtcattcagatgaaccttgtaaagaccagtgtacgttgtgccatctgccgcctttaatgaccaattaaaactgaattgttcagttcccgcaggcatcgtaaaggattttgtcgcggtattaaaggccacgccggttccctgaatattcgaaaccacaatttgatcctgactgacacctgaaatcgccacactaaatagatcacgcaaactaacatgagcagaatctgtataggcgtcggcattttgatttagagcatccggggttgtcggtacagccgtcgcggcatgcaaaactgtgatccggttattggaaaacgcctcttgatcaattgtcggtgtcccagcaatcgccacttcaggaatcagattagcattaaaagctttagcaccaatggcagtcacactcgctgggatattgagcgcatttaagatgatgtttgcttcaaacgcctcttggcctattgtctgcagacctgtccccaaggttaagttgctaattgagttatagacaaacgcatatttgccaatcgcggtgacactatccggcatagccaaaccattttgaatcttattgtagccaaaagcactgtcgccaattgtctgtaacccgtcatttaaagttagtgccgggattttgttgccgacaaacgctgcatttttaattgtcttcaaatttggtggcaacacaattgcattgttaatcgtattataggcaaaagcactgtcaccaattgactcaagcgctgttgcccgactgaagtcaacattttgcaacggtccaaactcagtaaaagctagatcaccaattgactgcaaattgggaccaaacgctacctgaacgaggtgcccaccataaaaagcttgatccccaatttgttcaagtgagtctggtaaattaatcgcggccgcactggaaaatgcgaatgcctgaaagcccaatgttgtcagccgactattgtctgcgattgcaaccgttcctagttttgacccataaaaagccgatccatcaattacgctgatgttcgccggtattgtcagcgtcggaatttgattgccaggattatcctgaccattaatgttaggcagatccttcatgttttggataaattgaaaagcgccgcctgtaatcgtctgaacatcaggaccaaacatcagattatccgtgaagagatggaagaaggcttggttgctaatcgttgctgcatcgacggtcacattcgtaatgcgtgcatagccaaaagcagtttcagcaagcgttgttgccttgccgcccagcgtcagcgatgtagccttagtaccgtaaaaggcattcttaccgatcgtcgctgatcctgccacattaatcgtgtcattaatggtttcgtaggcaaacgccgcttcgccaatattagcaacttcatcatccaacgtcagcgactcggccttaagcccataaaaagcattttgaccgattgttgccggacctgcgacactgaccacaccagtaatcgtggcataggcaaaagacgactcaccaatgttccctgcaccgttcaatgtaatcgcactcgcattgacaccggcaaaagcctctttaccaataacagccgcattatcgacggtgatcccaccagtgaatttactataggcaaaggctgaagcaccaattgtcgtgaccgtagaggcaacatgtaagctagtcaaattactcaagttaaagaatgcaacatcctgaatcgcagtcaccgtataagcttgaccattatacgagacagttggcccaatattaatgtcggtaagcgttgcaccagagtcatgacccgtaacggttgccgttttggttgtctcatcaaaactgtaagttaaaccgtcaaccgttgcgtcagttgtcgtggtattggctgttactgtaggttgagcagcagctgtcgcaaccggttgggcttgactactggccgactgctgtgcactggaagcttggctgttcgcggctgaagatgctgctgtttcactagcagtggcagcctgtgtagcagcttggtctgcagccgcggctgattgagccgctccagaccccgagaccacctgtgccgaggttgctgaggctacctgtgacgcatcagttgtctgttcaggggcagccgcctgactcgtaagtgtttgcgctgctgatgaactggatgtttgactgctagccgcgctcgccgcagatgaagccttgacagcctcgccagagttagtagcattcacagcattgcttgatgttgtcgcttgatcactagtcaccgcactttgagatgtcgctggctccgctgcctgtgacgttgccgttacttgtgtctgtggcgagcttgtatccgccttaacttcatgacctggttgaaaaaaggctggtataaacagtaaagcagctccggcaataagccaccgcttttttgctttatacatccgaaaacggacatgaaccgtctgttccgcctgtcgagccaattgaatccgtttagaatctagtttcaagatcatgatcctcctacagccatgttaatagcgattcccgtcacgacgcttaacgaaccatcttagaaacgatgattcacttggaaacagtaagcgtgtagaatctgtttttcattatataactgattttattaaaaaaacggaaaatttgtatccaattttcagaaaataattttataaatattgcgatagaatcagtctgaaaccggcattaacttaagtgcttgtttttaaatgtatcgcctatcctctgttgtttctgcaaatcagctgcatcttcgatcacaataaaaaaacacgatgttggtcaacgatccatcgtgttttttgacaagtatctttttagagcagaccctacttaccaatttttgcgcagttgcttcttttaatcgtgccggactcatcagcaactcgcttaaattgagcttctgaccacacttatcttcaaagcttttcatcattctatcagtatatttttaattaagattcgtttgtttgcattctaaacaaatggcaagcattttgttgtaatcgtaacaacaaggctttgcagattgttttcattttctagttgacttcatacagaacatcgcgtatgttaaaaattatcacataagatgagatttacatgagaggagttttgtcgatgaagttagatttggaactacgccctggggcaaatcgttttgtgagtgagtcaggtgccttggcatacttagatacgatcttagcggattttaatcaaccagttgtgattaccggcgaaaaaagttttgctgctttcaccaaggtttatcccggcgaattgaacttgccagtctatcattacgacggctccgccagtgatgagaatggacacgaacttgcacaggagatcggtcatgctgatgccgtggtaggaatcggtgctggtcgcttgatcgataccgccaaagttgcggccgaagccttgggtgctgagctcatcagcatccccaccttggcctctaactgtgcgccattcacaccgcttgccgcgatttatcatccgcaaggtcatacctttagttacgttgaatattttaaaaaatctgcctatattactttggtagactataacctcttattgtccaccccacatgatttctttgttgctgggattggcgataccttggccaaatggtatgagatggacggcattacccgtgataaagtggatcagttaaaggcatacggccagttgagtcgtgccgcggccaaaacgattcaaaagattctctttaaagatgctgaacaggccttggccgatttggatgccggccgcgacaccccggcttttgaggcggttgccgataccattatcggcttggctggtgaagtcggtggcttcggcggcattgatggtcgcgctgccggtgctcacgccactcacaatggcctctcctacttaccagaaactcatgccatcttgcacggttcaaaagtggcttacggcattctggtgcaactggctgaaaccggcgatgataccgaaattcgcaacttgattccattctatgaaaaaatcggtttgccattgaaccttgaagatttgcatgtcaccgatcaagtcgatgaaaagattaagcaagtggccgaattcgccgctaaaccagatgaaaccttcatcttggttgatccaactttaacccctgccaaagtagcagatgcgatgacaaaagtggaacaagtcaccagtgagccagcagcttaaagtccgaaatcggacaatctaatgaatactgtttcacaaaaattttaaaaaaccttgcagccctcttaaaatggttgcaaggttttttcgtttttgtattaaagaaagcatatcaaacaatgaccgcgcaaagtcctacttgttcatcgcgttgtcgattcactttgcaaataccctaacgccgccgcgccaacagccttggcagcaatcagaatcgcatcttcgtccatcataaagtcgggactgtggtgaggatgattagagccgtctggcagctgacagccaatgtagaagaaactgcttggtaccttttgggcaaaatacgcaaaatcttcggatgggtcttgaacgccagtgtccttaatggccttaatctccggaatatttgctgctttgatcgcggccattgcattttcggttaaggtcgcatcattcatcaaaaccggataattgtcatcatagtccagctttgttttaaccccaaacatggtttctagtccttggttcatggtgacgatctgttgtcgaatcgttttgcgcgttgtttccttcatcatccggacatcgcctttcaatacaacgtcttgcttaatcgcattgaaagaaccagcgccgtcaaatgagccgatggtgacgcttgccgtgtcaaaaggatcaactcgccgcgacacaatcgtttgcagtgccgtcaccaaatagctgccagccacgatagcatcgttgctcaggtgcggcatagaagcgtgtccgcctttgccgataatcgtatcggtaaagttggcccgcccggtttgggttgcgcctgtgtggtagccaatcaaccctgtcggcatcgctgacatgacatgaacgcctaacacattatcaacgccttcgagaacccctgctgctaccatccccttggcaccacctggagagacttcctcagcgggctggtgaatgattcgaatggtaccggccaatttggctttgatcttgatcaattctttagccaacaccagcaaataagccgtatgcgcatcatggccacacgcatgcatcaccccaggattctgagacttgaacgacaggtcgttatcctcttgaatcgccaaggcatcaaaatccgcccgcaacgctaacgtcggtcccggttgaccgccttgaatatcaacgtacatgccatagccctccccacacggcgtcacggggacgttcaaggctgcataatattgtttgatataagcagccgtttgtttctcatgaaacgaaatttccggatgagcatggagatgccgccgaatcgcaagcatttctgattcatcggcagccagtgtctgcatcaattgttctgttaaagtcatggtctttttcctctctgtgattttgtctgaactttcggcaactttgcaattaggcgaacaagttgcggtcgaacggccttaaaaataacctccgcgaccacaaaaccgactgccagtgccatcgcaatcaaaatgacgttatagatttgctgcgcagcactcgcggcttttcccatggtgaaactgcgcgcacctagataagcaatgccgcctggcaccagtgatacaagacttggtatgtaaatcgtattaaccggcacccggtgacgaatagcaaaataattccccagcaatccgatgattaccgtggccgtgaagttcggtaatatgagactgtgatcctgcaggctgatgagccagtatgcacaccacgaaacaccgcctgtgatcccagctggcagcaaggcgcgtttggggatgttggtgatgacgccaaacccgatgctcgacaagacgctaatcagaaattcaattaataagcgcatgctagcgccctccccaaacattattcagtacaatcgcaataacgaccccagaaccaatcgcgcccgctacaaaaatggcgtctacagtgcgaacaatgccgctgatgatttgccgcgaaagaatttcccgaatcgcattggtgatggccaccccaggaaccaacggcatgagggcactaataataatattgccggaactatcgccccacccgatgctcaccagtaattccgctaaaatggccaccacaaaggcaccagtcgcttctttgaaataaggcgtcgtcgtgcggcgaccgacatactcagccgcaagataaccaaaaataccaacaaaaaaggctaaagccaaatcaccatttgtcgctttgaaaagcagcattggcgcgaccgaaacccaaccggcgcccagaatccgcgcccaccatgggaaattaatgacttggtgatcaattcgcgcaacttcttgcttaagggcttcaaatgttatccgatgagcgacgaattcacgcgacagttgattcaactcatcgaccttttgcaagttgaatccgcctaatgttgatttgattaagcgcgtacgactttcgttctccaaactgacaaaaactgccgtaatcgtggcataacacgcaacgcttacccctgccgcatgcccgatatattccacggttgtctcaattcgtgatgtctcggcgccgacattcagtaaaatctctcccaccttgccgcagacttctaaaatttcctctgttcctggttgactcatcgcgtttgctcctcaagatcgcgtttccgcgttttgcattttattaattgtcggcttttttgatagcggtggcaagtgatgacattaggcaatcgccagcaaatttttctgaaaaggtttttcatttattaaccccttaaacaaatgaaaacacaagtgcgttatggcgtgttaaaaccaatgaaagaaataaataacaaaacataaccaatgcctaaaaatgcaattatcagcagtagcgccaaagccagtttcactgctaatgaaaaatcttttctgcgcaaaatgacgactatcccaagtcctaataagatgagcaccagaaataaaaagaaaaaaagtagtgctctagatgtccaaaagcctaacatggttcccactcctctaatttcatcttgctacttagccgttcccctttttttaaatcgataattcgccgacagtgacaaggcaaaaaagcgtcatgtccagtagactttttcagcttatcaaaggttgcttcaaagcacaaaactgttgcttctcatgatcacgcgcccccgtccaaggctacttacacgtcggtctctccccgggctggcttggcatcaaaaaaaccgaatcgccagctagtttggcaattcggtttccaatttattgggccactttactaatgcgtccctgctcaatgtacactgacaaaatcgccacatcagcaggattgacgccgctgatacgactcgcctgcgcaatggtttctggctggattttaaccaacttctgacgtgcttcagttgccaaaccattgatggccgcgtagttaatacgtagcggaatctttttgccttctaggcgcttcagtttggcgacactggcttcttcctttgcaatatagccagcatacttaatttgaatctcaacctgctcaatgacacgatgatccaaagtcggattatctggcaagaattgcgccatcgtctgatagtcgatttccggccgcttcaggaagtcgctagccaagacgccatccttaagtggcgcataatgatgggcctctagccatggattcacgtctttaggcttcaaccgggtcgtattcagccggttaagttcagtttcaatggcctgacgctttgccaaaaattcagcatagcgctcatcgctaattaaaccaagctcatggcccattggtgtcagccgcagatcggcattgtcatggcgtaacaaaagtcgatattcagcacggctggtcaacaggcgataaggttcattcgtgcccttagtcaccaaatcatcaatcatcacaccaatataggcatcggaacgcttgagcgtgaacggccctttgccttgggcacgcaacgccgcattgatgccagccataatgccttggccagctgcttcttcatagccgctggtaccattcatctggccggcagtgaaaagattatcaacgactttggtttctaacgtggccttcagttgccatggctcgatcacatcgtactcaattgcatacccggcacgcatgagttcggcatgttccaacccagccacactatgcagcattttcagttgaatttcttctggcatagaagtcgaaaaatcaccgacatagtattcggaggtatcgcgaccttctggctctaaaaacagttgatgccgcggcttgtcagcaaaacgaacgatcttatcctcaattgatgggcaatagcgcgggccaacccctttgatcacaccggaaaacattggcgcccgatccaaattatcgcgaataatttgatgggtcgttgcattagtgtaagtcatccagcaactaagctgatccttcaaataaactgaatccggcgtcgtgaagctaaaatgattcggagtcttatcgccaggctgttcctcggttttatcaaagtcgatggtgttgccattgactcgcggcggggtcccggttttaaatcgccgcaatttgaagccgagctgttcaagattttctgacagcttgatacttggcaggctgttattagggccagaactgtacatcaactcaccgatgataatcttgccgcgagaactggtgcctgcggtcaaaacaacactcttggcccgatacattgcgccagttgccgccacgataccgacagcttggccattttcgacgagcacctcagtagcgaggccttgacgcagatccagatttggcgtgttttcaatcacgtgtttcatgctgcggtgataggccgctttatcagcctgtgcccgtaatgcgcgaacggctgggcccttgccggtgttaagcatccgcatctgaatatatgttcgatcaatattcttgcccatttcaccaccgagtgcatcaatttcacgcaccacgattcccttggctgggccgcccagacttggattacacggcataaacgccagcatttccaagctaatcgtcaatagtatcgtcttttggcccatccgcgcggctgccaaagcggcctcacaaccagcgtgaccagcaccaacaacgatgacatcataggtaccggcttcaaattttttgacatcaggcattcgatttcctccatgaataagtttctaattggcactgagctttacttgcccaagcagaattgactaaacaattgggtgattagttcatctggcgcactttcaccagtaatttcaccaagtttatcccacgccgcagtcatgtcgatttgcacgagatcaattggcataccagcatggattccggcgatcacagcgtccaagctcttgttggcttggcgtaatagcccgatctgccgagcgttggaaaccatcactgttgtttggctattttcgatgccgccgaagaacaacttcgcaatccgttcgtctaaggcatccatgcctgcgctagtcgggatagcggtcttgatgatttcatccggcgaaaccaacttcaacaaggcagtggtatctagctgtgcaggtaagtcctgtttattcaaaacgataatccgttttttattagctgttgcttgaatgagctgttcgtcttcatccgtcaatggttcactttgatccaacactagcaaaatcaaatcggcttgtgtgatggcttgacgtgagcgttcaacgccgattttctcgactttgtcagtcgtgtcatgaataccggctgtgtcgaccagttttagcgggacaccacgcacgttgacatactcctctagcacatcacgagtcgtaccagctacatcggtcacaatcgctttatcctcatgcaacatgtgatttagcagcgaacttttcccaacgttgggacgaccaacaattgcggtggctaaaccttcgcgcaagaccttgccttgactggcggtactcagcaaattgctgatagctttttgaacggtttgcgccttttcaagcagcattttggtggtcatttcatcagtatcatactcaggatagtcaatgttgacttccacctgtgccaacacttcgaggatttcctgacgaaggcgtttgatcaatgtatgcagattaccgtctagctgattgactgccacctgcatcgcccgatcggttttggctcgaatcagatccatgaccgactcagcttctgtgagatcaatgcggccgttcaggaatgcccgtttggtgaactcacctggctcagccatccgtgcgccttcgcctaagagcaactgcaaaatgcggttagtggcaacaataccgccatgacaattaatctcgacaacatcttcacgggtaaaggtcttaggtgccaacatgacactaaccatgacctcatcaatcaattcgccgctttcagggtcgacaatatggccataatgaatcgtatggcttttaacctgcgagaggtcttttcccttgaaaacttgattagctgtcgctacggctgtctcaccgctgagccgaacgatgctgatagcaccttcgccaggcggggtggagatggcagcgatggtgtcgtacgcagtgatggatgcagacatttgaaagactcctttttgagatgattcggtaagaaaaatgagttgatgggattggacatggcaggcgactgaggcggatgagtgatgtggcggcctctgaaacacgcaatggaattgtagagcctgcatgtagggatttgtgtggtaaaggccaatcccttcatggcctctgaaacgcgcaatcaggcgcatctcggctatgcgaaggacagtccaaccagatggcccaaagcccagactttctggttagggggctaggcggttccgaaacgcgcaatcaggcgcagaaacctgcacataaggacatcagacctaaatggcaaaaccagccatttaggtctgatgccacttatgctccggtttctaaccgcgtctgattgcgctctacaaaaaaagcgcaaaatccagtctttcccccctatcagggaaagactggataaagcactttgactacttcatcgttattaaactgtgaccatcatacttaagcaacggtcacttgtcaaaagttagttacggtcttttgggtgtgaccacgacatatcgccgaggatcgacgccttctgaatgggtctcaacgtacgtattgtccacaagtgttgtatgaatcgttttgcgttcaaatgatggcatcgggtcgagatagacggctttgccagttgctaaaacctcgcgagcggtgcgttctgctaaacgtgtgacggttgcctgccgtcgttcgcgataatcgccgacatcaagcatgattgtccatttacttttggcataatgattgaactcagtttgggctaagtattgaattgcattgatgattttgccatgcttaccgatcaacaggccttcttcatctgttttcaactgaaatgtgaccgtgttaccttgccgttcacttgtgacttgagtgtcgatccccataccagtggtgatgtcttccagataactctgcaccatggccaatgcggtttgattatctcgctttttggtggtgatatcgttgaaagcactggcaattttcttgcctgcaccatcagttaaggccgttgcaagttttttccctgcccgcggtttggcaggcggatcgtcgcttggcgtcggatcagcgtctatcggcggttccaagggttttaaattaacaatcgctggcttacgcatcaagcccagaaatccgttcttattttctcgaacgacttcaacgctaacggcatcacgcggcaagccaagctgcttgagaccagtttcgatggctttttgaatcgtactgccttgaaaggttggcatcttgcttcctcccgttgttatttacgccgtttggttgcttttttgtacgctcgcttgagtacccgttctttttctttttcagcctgcgcttttgcttcacgttcgcggcgaatcttgaatggattctggatcagcaactgctgaatcattgaaaaggcattggtaactacccagtaaatggccagcgcacttggcaaggtaattgagaaaacgaaaatcatgacaggcgagacgatcatcatgagccagctgctagaattacgcgttggttgtgccatcatggataagacactagtacccaacgtgaataaagttgccagaatctgcataatccacaacggatctggttgtgacaggttcatccaaaggaaagtacccgtttgcagtgatgatgtgcgcaaaattgcttgatacaacgcaatcaggaatggcatctggatcacaatcggcagacagcccatcactgggttaaccccagctgaagcataaagtttctgtgtttcatcacgcagtcgtgtctgggtttccgtatcctttgaactgtacttcttttgtagttcttttagctgcggcgcaatttcctgctgtttggacatgctcttgattgacatgtaactcagcgggaaaatcaaaattcggatgatcaaggtgaaggcaataatcccgacaccagggttgccaccgaacaaattcgccagccagataacaaattgaccggctgtgtagacaacatagcgatcccagaaccccgtactattttgcgtaacgggtccggttccgcaggccgtcaaaatgaagaccaggcttagcatgctcaaaatgacgagcacacgtttgatttgacgatttttcacaaatgatccctctcttttttaaacgcggtcgctaggcgcagaaatctgcacagaaggacctcaaatttaaatggctaaagcccagccatttagatttgagtccgcttatgctccggtttctaaacgcgcctgctcacgctctggtcagatgacctcgatgtcttcgttcaggatgccagccaatcgcatgatatgaatcaaatttttcttggtgccagccatgtcgagctggttagcagatttacgtgcaataaccaaaaaatcggtttgcgcgtcaatattaggttttaactccagtaaactttgccgaatatagcgcttaatctggttacgcatgaccgcagtgtggccaactttcttccccactgagataccaacacgaaaatgcggttggtcgcgtttcatgtgatagatcacaaaattgcggttggcaaccgaatcgccatggtcaaacacattctgaaattcagcttcttttttgatccgatatgacttgcgcaatgatgctccctcacaatctggttctaagtatacaagatgactcggtgttttcctatatgtatcagcggtttgttgacggtttctaatctgcacattgaaattaagctgttgagcagaaaatgaacggcaacgaccaacgattgggccattgccgttcattggggtcatgctgctgtcgccgaaacgcgcaaacaagcgcagaaacctgcacgtaaggacctaagtcgcaatgaccaaagaccggtcatcacgacttaggccgcttacgctccggttcctaaccgcatttgtttgcgctctaaaaaaaaccactgacgcggtcagtggcttaggcagataatactttacgtcctttagcgcgacggcgtgctaaaactttgcggccgttctttgtgctcatccgcttcatgaaaccatgaacacgttcacggtgacgtttctttggttggaaagtccgtttggttgtcattgacgacacctcctatgaaaaacgatttatcttattaagatgacttgcattatcagacatcatccgagtttacacgaggaagcaactatcgtcaaggttttttccattgaaagcaggatctcatgatgatgacacgacatccacagatagttatgaacctgtggataacttgtgtctcaaatttttaggtttcggtcatttccacaaaccaatcacaggaaattcgcagataaacaggggtgtgaagaaagttatccacaagctgtcaaagccctgttcatatcttgtgaaacacttactgctacaaggtttttgttccacagtgccaatgtgcataactgcgaatttattgtcatcacgctttcgttgtccccgaccttggggatagtctgttcgcaccctgttcatttctcaattttttgtttgtggaaaactgtgctttctgtggaaaacttacgccagcaatgctaaacttatttttacagagcgtgaattggcgcgttcagtaaccgaagtgtaagcggccttgactgtgatgaccgggctttggtcaatgcagtcaaggttcttacacgcaggttgctgcgccaatgaacgcgttttggcagagcgctcgcatgcccggttagaacccggaacataagtggcctcgagtctaaatggctgctctttggccatttagactcgaggtccttatgtggaggtttctgtgcatgcgagcgcgtttcagcagagcgtgaattggcgcgttgaataatcggcgtgtattggccttgcctgtgatgaccgggctttggtcaatgcagtcaaggtccttacacgcaggtttcggtgccaatgagcgcgtttttatataggaatgtccgtcatcactcgtcagcatagctataagctggtttgctaccggacataattggaggaggggcatga

SEQ ID NO: 5 - DNA, 9826 bp, Lactobacillus paracasei
tagttcgtctgatatggcctctgcctatgcgcagtttgcatcagtaggtgtaaaaggagtaggtagtcttgtcaaaggcatgggtggcttagctgctgctactgatgacccaaagcaagcgatgaagacattgatggaacaaggcacacagatggccgcaaagccaatggttcaatgggctgacttccgtctgatgctagaacagactcctgctggtatggcagccgttgctaaagcaatgggcatgagcaccaaagaactggttcagaatgttcaaaacggcaaaataagcacgcagcaattcttcgatggtatcgaaaaggcaggcaacagcaaggctttccagaagatggccacgagttacaagacagtaggcgaggcaatggacggccttcaggaaacactggcaaacaagcttcagcctgcatggcaggcaatgtctaaagtcgctatcggagctattagtggaattatcgataagatcggagccatgaacttcgattcagttcttgcttcaattggtcgcttcttttctccgttttcggcattgattatgaatattaagacacaactaagcagcttaggtaagggcgactcgatgagcggactcagttccgttttcaaaggagtagggtccgttttacaaaccatttggagcctagttggtagcttagccaatgttgcatttgtcaatctgattggcattgctcaaaaagttggtggtgcgttcaattcggtgtttggtggtgggaagatttcgggagttttcgatggtatcaagcaagccgtcactgactttggctatgcagccatgggagccatcacaactgttagtgatattattgctaacttaccgtggaaagcaatttttgaaggtgttaaggcggctttaactggtgttgttaacgtgctgaagccaattgcagctattgtcaaagcagcatttgcaaacgacattgttaagtcgtttgcagtggcaatcttaggagctgtgggagcctttaagggtattagtttggcccttgaaggattctccagtgtcatcggaatcttttcgaggatgatcggcccaattcgtggcgttatcgctgttgttactaattttggaacgattgcgaaaactgctggcggtatttggaaggctttcggattgatcttaggcatgaatccgtgggtacttttgattgctgggattgcggcagtggttgctggtctggtgtacttttttacccaaacccagactggtcaaaaactatggtcgggatttgtttcgtggttacaaggagcttggcaaggacttgtaggagttgcgcaaactgtttggaatgctatatctggtgcgtttacatctgcaattagcggcattcaaacagcttggagcggaattacaggtttctttagcaatctatggactgggattacgaccacggcatcagctgcttgggtggcattcacaaccactctctcagctatctggcaaggtgctgttacttcagcaacggcagtttggaacgcgctatccacattcttcacgactctatggaatggaatagtagcagtagccactgctgtatggtcaacctttggcggttccctgacgacaatttggaatgggattgtccaagttgctaccggtgtttggaacatgcttaaagcagttattatgggtcccattcttattgtcattgatttgcttactgcaaattggacacagctaggcgctgatctccagctgatctggaacagcattgtttccgccgctggtcagatatggaatggccttgttacgtatttctccggtatttggagccttattcaaacttatgcaatgactgtttggaatactttggtttcaactttagaggggctttggaatggtgcagtatctgccgcttccgctatttggagtgcgctttcgtcatttttcagcggattgtggaacggtattgtgtctaccaccgaaggcatatggaacagtgttgtttcattcttatcaggactatggagcggaacagtcagcacagccgagggaatttggaacgcacttcccggattcttttccggattgtggaacagcattacatcatttttttcatcagcttggagcaacataaagtctattgtgattggagctgctactagtatttttaatggtgctaaggctgtatggtctggttttactggcatggtaagtggaatagttaatggcatcaaaggagcattcaatgcgcttcgtaattttagcttggctgacgctggccgcgctatcatggatagcttcttcaatggcctcaaagcggcttgggggaagatcactgattttgttggcggaattgcttcttggattcgcaagcataaaggcccaatcagttacgatgccaagctgctcatacctgccggtaacgccatcatgaacggcttgaatgcagggcttactgacaagttctcacatgtccaaaagaacgtttcgagcatggcgcaagctattgttgacagtgctgctgttacgatgccggcagtgaatacttctccatttgatgcatcattgcagtcgcttaatagcagtgttcagggtgcaaccttgtcttcaaatcttgatgtcaactacactcgcaagcaaacgattgaggttcctctgtacattgatggccgagaggttgctcgtgcaactgcaaacccaatgcaaacagagcttaatcgtttgacaaaggtaagcaattatcgaaaggggttagtctaattgtacgatttcagagaaacgacacccttcacgggtgcagacgataatcagcttccagcagaagcgatgctaatcgatggacaatacattgagaatcttgtgcccggatataggacacttcaggtcggagggcgtgagcttcttaaacaagacgctaaaagcaatcctataggaatatctgatggcgaaatgctggagtatgtacgaaacccatctcgggaaataactgttggatatcagcttatagcagctgacgaaaagtcgtttcgcactgccttctataagctaagtggcatcttgcacggtgacactcatcaggtttcgttcaatgatgacttgtctgtgtactggaatgccgttctcacagatgttgacgatgttcctaaaggcagaaacgcaattacatcttcgttcacgctattcgttcccgatggcatcgcccactcggtagccacgaagacgtttgacaacatgccatacaaggacatgccagtgaatttgttgacagggacaagctatatggctactgctgaatccgtacccaagggcgcctttaaagccagcaatgcaaaaaccgtttcggtttcaagcggggaaacttatacgtactcaattgaaattccgtctaacaatacagttgacttagaagcggcaataaatcttaactctaaaggggtttttgtaagatcagtgatcggaaatgttatcaaatcagggcaatcaggtatttcaacgattacccttacggtcccagatggaattgacagcctgtttttagcaataagtcttacaactgtaaatccaaattcagcgacaactatttatgaagccggtgaaaagtttgagctaggcaaaactgcttctccatggtcgcctaacccagctgatcctgaatactataccaacaccatcacggtgcacaatggcggcacttatcctgttgagccagttattacggcaactatgcatgctgataacggcatggttgggattgtcaatgatcgcccgggtattctccaatttggcacgcaagaaattgatggtttcaccaccgaagaaagcgaagtggcacttgatttggcagccgttcaaggctcgcacatggataatcaagccgccacaaacaatccctattggggtggtgatcctagtatgcctaatgaacagattggcaatgcgatttggacgcaggacggctacgatggctggaaggttgagcctaattggcccagtattactggcgaccacaagtattggaacggtccttcaatcaagcacaatctcgtccagacgcataacggtaacttcaagagcaatctcacatgggacgttatgacacgcttccaaactggggtagcacaggtaggtgcgctcgaaacaacgttagagagtgacggtaagccaatttttcagatgatactgaaggataatagcgcattgtccgatcagctttggtggatgtgctattacaaagatcaactggtcgtcaatgaacaacttgatcgtagcattttcactaacgacaagttcattcagttggaattacaaaaatttggtaattcagttgttttccgagtgtcaccatggattggcaatcaaggacgagagacgactattacccgccagtttacctttgcggacgctgccgatactgaaactaaacaattttccacgtggttcatgcgagacaagacatggggcgagtcgactatgtatctgattgcgtccaccgtcaaatggcaaaacgttagctggtatacgaatatcaagaatcgttttagcgatggtgatgttctcaagattgatgtggcgaacgctaagacgtacttgaatggttctcttgacccaaccatgcacacgttaggtaatcaatgggagcaattcaaactgccgcccggtgatactgagattgctatcacgccctcgagctgggcacaaccatttgcgtgtgaagtcgagataagggaggcctggctataaatgaagtattactttgcagatcgaaaatcaaacattttgggtgttgggtcgaccgatggcaaaggcgaatggcgaattgacaacgatatcgaaacacaaagtgttgataatcgtcctgcggtcgagctttctcttgatattcacttcacgactgatcaggaacaagcagtcaatgagatggctaaagcaaccaacttcatcatgtatcaagatgaagaaggcaatgctcaccaaatggtgattgaatcggttgaccatgattcactaggccacattcactcaattgttgccagcgatgctggtaatgatttaattaacgaaaccgttggcgccttcaaggccgacaagccatatacgattgctgaatacatcctcatgtttacaaatgattctggctgggagattggcatcaacgaatttcctgacaatgttcgaacactcgagtggactagtgaagaatcatcgttggctcgcattattgccgtggcaaaagattttgatgcagtgcttagttttggctttgagtttgttggaaccaacttggttaagcgtgtcattaacattcggcatgaaacggccggtgacagcttgatttcctttgaaatgaataaggacatcaacaatatcgtcacgcacctcgatacctatgacatggaaacatcgattaaggcttatggagcggtgccagaaagcacggatggatcaactaatcaggatccaatcaacttgatcggctacaaatggactgatccaacgggacagtttgtgcttgatcagtacgggttcttgcacgataccattgctgtgcagaaatattcacgtttgttaagcaacagcaaccctaacccaacacagtctgactggaatcgggttaaaacgtttgattcaaaatcgcaggcggcacttttgcaagcggctttggcagacttgaaaaagtataaccacccaaacgaaacgtacgacattgatttggttaattcgccatacgtaccgcttaatcaaaccgtccacattgccgatgagaatcaacagctattcctgtctgccaaagtgttgagcattcagcgcagccgtgctaaccattctgtcaagcttactttgggtgagttcgctcatgaaacagtcagctttgaccaacggctcagcgatcttgccaataagatggccaacatgcccaagactattcagttttatccatggcttcgttatgccgatgatgacaaaggcactaacatgagtgccttcccaactggtaagaagtatatggcaatcgtttggtcaaataagacatccgttccaagtgataatccggttgattatgctggcaagtgggcattgattcagggcaaagatggcgctgacggtgttccgggtgcaaaaggcgctgatggccgtacaagctatttccacactgcttgggcgaatgatgtaagcggccaaagcgggttcacagtatccggcggtgatggcaaaaagtatattggtacgtacagcgacttcacgcaggccgatagcaccaatccagctgtttatagttggcaactggtacaagggccaaagggcgatactggtccgcaaggtccacagggaccacgaggtccgcaaggtgttcccggaagcaaggatgtgccatacacgtacattcagttgggcacgcctgctagccccaagaaaggcgatttgtggtggcatgggacaacacttaacgatgccacagccctgcaatactataacggtacagcttgggttgatcaaagcattcagcaggcggttctcagtatcaaaaagctgcaatcaattgagattgacacatcaaccatcaattcgcctgacattaattcgccattcagccacgttcagattgacggtgccaagagttctggcaatcttgaactcaaagatgcgcatctaagtatattgggcaacattgaagacaataatggcaatcccaacggtcaatactacaaatcacttttgagcccaaacggtatgttcaactacatcacaacgcctgatcaaaaggggagcgtgtcgtcagttgcgctccaacgtggtgcacttcagttacaaacgctgatcagtgaccccagtgccgctacaaaaaaatatattcagtctgaattcacttcaaaagacaacgtgacatttttccatgttgatacaaccccagcaaaaaatattgatattgattgggcatatatttactacacaagacgtggcaatttagtgaccgtcaactttcaatttcacacaatagctaatcagtacaattatttgaggctcgcagatattagacctggttacacaccttatttgaaagacaaaattgttgcaagctgttctaacttttcaaatccaagtagttcgtcagctatctattcaagtacacctcgtggtgggactgtgggatggtatggtgctcttactcatgactttggtagttggggaggatctgtttcttacctaaccttagatgactatccaacgggggatacattttttaactaggaggcaattatgaaattaaaagtgtggacggatagcaataatcggctgcttaattgggcatatgctgatgaaaatagaccagtaggtccgaccgatgaaggattcaaggttattgaagttgatgaggccattggcttgtatgagaaccacgccagcattgttgatggcaaggttgttccagatgctgactattccccagatgcttacagacctgcacctgagccgtctgcggctgacttagcaaatgctgaaactatgaagatggttgctagtctaactatgtcaaactcagctttgataaagcaggtggcaacattgaccaaggaggcaaaatcgtgagcgcatataaaccattgattatcagttactatcagcaaggaatctataataaggatgacttagccttgttcgtgagtgtcggatggattagccaagcagaagtagatgagcttgttaagcaagtcgccagcaaaagctagcgactatttttgtggaaggaagtgaaaaagtgacattttttggatacacgattggtgactgggcggagttaatatcaatcataggggtgggcgtgagcgctggcagctggctgttcaaaaagattgccctagatccattgcgttctgacattcaaatgctttcagagacgattaatcgtcagctcaaactgcacgaacaatcgctggcagacttgaatactcatctgaaagcacatgatgaagagcttggcagtcactcggttaggattactcgattggaagaccatgtaggcattaaaggagataatgatgatgaataactggacagaacttttggtatcacttgcagtagcagcagtcccaatcattggggcttggatctcaaaacagttgctggctaacaagcaagcgctcactttggtaaaggtattaggcccattggcaaatgctgcggtaacagcggcagaacagcttggtgtgacacaggcgattgacggtgaggttaagaaatcgactgccattcaggctgtgaaagacggcttaaaatcgcttggcttcaccagcacagacgagcagacaattgccaacgcggttgagaaagcttttgcggatttgaaagacagcctagcagaaacctatccgcaaaagacagctgatcaggaagcatctaatcaagacaaagtggctgccgcagctcaggctgccgcagacgcagttaaggctcagctggcaccggattctgctgctccacagcaataaggagggcacatgaaatttaaaactaaactaatcaccttggtagtcgccttcttggcggctatttcttttgccttgccatcgcatgtcaatgcggccaagggcgatatcggtgtggactgggcagtttatcagggagccaacgggaaatatggcacgaataacaagttcgcgatcattcaggctggcggtacacaaggcggtacgctgtatgatcaatggacgtatgcaagccaagtcaaggcagcacaggcgaatgggctcaaagtccacacttatctgtggtacggggtcggtggcagtgctgatattggccgacaggcacttgactacttccttcccaagattctaacgccgaaaggttctattgttgctcttgattatgaggacggtgcctcatcaagtatggctgccaataccgatgccattctatatggtatgcggcgcattgcgcaggcgggatatacgccaatgtattacagctacaagccgtatacactggcacacgttgactatcagcgcattctagcggagtttcccaattcactgtggatcgcggcctatccggactatcagattcgggcattgccagattatggtgtattcccgtcaatgcccggcattgcgctctaccaatttacttctatgcatgcggcaggcggtcttgatggcaacgttgacttgcttggcgtaaccgataatggatacagtcaacaacctgtcgcgccatcaaagcccgcaacaccatcgcaaccgtctacttcaacagcagccagtgataccgactatgcgcaaactggtgttttcaagccgtccgcgactgttaacattcgcactggtgccggcaccggctatgcatccgttggtagctacgcacccggtgaaagtgtgatttatgatcacgtgtatatccgtggcacatatgtttgggcacgttatctcagctactcaggcaggtatcattatgttgccttgggcgtgaatggtggggagagctatggctcgcgttcgtctggatatacttcgccggtaagccacacgtactacactgtccgctctggtgacagcttctggagtattgccagcaagtatggcatcagcatgtacacgttagcggctaacaacggtaagtcaatctacagcctgatctacccgggcgaaagcctgtatatcaggtaacaaaaaggtcctctgctcgctaaggcgggtggagggcttttttacttatgcaataatataaatataagtaattcgtggtgaagttgtggtgaagtgaatccgaaattatgaaacctaagaaattgatatagagctatttttgcttttacaccggcgatttgaaaccctatgaaatcagtgctca
